United States Patent 7,759,478 (BIOINFORMATICALLY DETECTABLE VIRAL REGULATORY GENES) - sequence listing, part 2

SEQ ID NO: 36173 - RNA, 23 nt, Homo sapiens
gcguaaaacaggccaucccacca

SEQ ID NO: 36174 - RNA, 21 nt, Homo sapiens
ggccucugcacugacucauuu

SEQ ID NO: 36175 - RNA, 18 nt, Homo sapiens
ugcuguuguaaauacugu

SEQ ID NO: 36176 - RNA, 19 nt, Homo sapiens
aggaagauguaagguuuac

SEQ ID NO: 36177 - RNA, 23 nt, Homo sapiens
ccagucgucagcuccuucccuca

SEQ ID NO: 36178 - RNA, 17 nt, Homo sapiens
cuuccugacccuccgcc

SEQ ID NO: 36179 - RNA, 22 nt, Homo sapiens
ccauacccccacauccaccucc

SEQ ID NO: 36180 - RNA, 18 nt, Homo sapiens
cugcugcauguuguacag

SEQ ID NO: 36181 - RNA, 19 nt, Homo sapiens
gucuccagcccccugcccu

SEQ ID NO: 36182 - RNA, 18 nt, Homo sapiens
aggcuggaggucagccac

SEQ ID NO: 36183 - RNA, 18 nt, Homo sapiens
cgcggagugcgaguggga

SEQ ID NO: 36184 - RNA, 18 nt, Homo sapiens
ugacugccagcgugcgga

SEQ ID NO: 36185 - RNA, 17 nt, Homo sapiens
caacaacuuagacugca

SEQ ID NO: 36186 - RNA, 18 nt, Homo sapiens
cagggucccaauggcacu

SEQ ID NO: 36187 - RNA, 23 nt, Homo sapiens
cggagcagcucagcccugcagug

SEQ ID NO: 36188 - RNA, 21 nt, Homo sapiens
cuaugaauuacagaacugucc

SEQ ID NO: 36189 - RNA, 20 nt, Homo sapiens
cugaugaguauccgauccug

SEQ ID NO: 36190 - RNA, 19 nt, Homo sapiens
cugcaccuggaggaucuca

SEQ ID NO: 36191 - RNA, 21 nt, Homo sapiens
cugggcaaaguccucugcuag

SEQ ID NO: 36192 - RNA, 15 nt, Homo sapiens
gaugugaugccccuu

SEQ ID NO: 36193 - RNA, 23 nt, Homo sapiens
gcccucgggugauuauuuggcuc

SEQ ID NO: 36194 - RNA, 20 nt, Homo sapiens
uccgcgcucggagcagcuca

SEQ ID NO: 36195 - RNA, 18 nt, Homo sapiens
ugggaucaacagaaacug

SEQ ID NO: 36196 - RNA, 17 nt, Homo sapiens
uugguggggaccgacau

SEQ ID NO: 36197 - RNA, 22 nt, Homo sapiens
ccaaugcaacccacccaauuga

SEQ ID NO: 36198 - RNA, 21 nt, Homo sapiens
gcugcgcgggugaccugugaa

SEQ ID NO: 36199 - RNA, 21 nt, Homo sapiens
aaacauuugccaaauccaacu

SEQ ID NO: 36200 - RNA, 20 nt, Homo sapiens
aacauuugccaaauccaacu

SEQ ID NO: 36201 - RNA, 17 nt, Homo sapiens
gaacuuucaaaaucuca

SEQ ID NO: 36202 - RNA, 20 nt, Homo sapiens
uggacaaauauauuucauuc

SEQ ID NO: 36203 - RNA, 17 nt, Homo sapiens
uguaaacauuugccaaa

SEQ ID NO: 36204 - RNA, 17 nt, Homo sapiens
aaaguuacauuuccuga

SEQ ID NO: 36205 - RNA, 22 nt, Homo sapiens
aacaaaaaucuauuauguaccu

SEQ ID NO: 36206 - RNA, 24 nt, Homo sapiens
aaccagcugagcagcagcagucua

SEQ ID NO: 36207 - RNA, 22 nt, Homo sapiens
acaacucaaaaaacauuuagca

SEQ ID NO: 36208 - RNA, 23 nt, Homo sapiens
caaucuuccagagggauggggca

SEQ ID NO: 36209 - RNA, 17 nt, Homo sapiens
cuccauggauucaggga

SEQ ID NO: 36210 - RNA, 20 nt, Homo sapiens
ucaccucuggcucuuugcca

SEQ ID NO: 36211 - RNA, 19 nt, Homo sapiens
ucuguccacacauuaucac

SEQ ID NO: 36212 - RNA, 21 nt, Homo sapiens
aucuuggucuccacaaacucu

SEQ ID NO: 36213 - RNA, 19 nt, Homo sapiens
auucuaccuuuuucuaaca

SEQ ID NO: 36214 - RNA, 24 nt, Homo sapiens
ccuaacacaggcugaaacuaaaca

SEQ ID NO: 36215 - RNA, 16 nt, Homo sapiens
ggcaggggcuuuguca

SEQ ID NO: 36216 - RNA, 24 nt, Homo sapiens
guccacaccacucaccacacauac

SEQ ID NO: 36217 - RNA, 24 nt, Homo sapiens
ucaguaaaaucuuaaaugauuuuu

SEQ ID NO: 36218 - RNA, 23 nt, Homo sapiens
uccuuuucuccccucauuuccuc

SEQ ID NO: 36219 - RNA, 22 nt, Homo sapiens
agugacggugggauccacaaca

SEQ ID NO: 36220 - RNA, 21 nt, Homo sapiens
ggguuaugggugaccuacaca

SEQ ID NO: 36221 - RNA, 16 nt, Homo sapiens
cagcuggauguacaau

SEQ ID NO: 36222 - RNA, 17 nt, Homo sapiens
cccagagccgugcccag

SEQ ID NO: 36223 - RNA, 15 nt, Homo sapiens
caaauggcaacacca

SEQ ID NO: 36224 - RNA, 23 nt, Homo sapiens
ccauuaaaaacacagcaaucauu

SEQ ID NO: 36225 - RNA, 23 nt, Homo sapiens
cuuacauagucuuaagcauuuuu

SEQ ID NO: 36226 - RNA, 20 nt, Homo sapiens
uugaugacucuuacauaguc

SEQ ID NO: 36227 - RNA, 26 nt, Homo sapiens
uuucuucaaucuuuggucuuaguuuu

SEQ ID NO: 36228 - RNA, 19 nt, Homo sapiens
ccugcugagggagacacca

SEQ ID NO: 36229 - RNA, 22 nt, Homo sapiens
cucugauggcagugcuugacgg

SEQ ID NO: 36230 - RNA, 20 nt, Homo sapiens
cugauaacugagcuaaucca

SEQ ID NO: 36231 - RNA, 18 nt, Homo sapiens
gacaaccccgccuccucu

SEQ ID NO: 36232 - RNA, 22 nt, Homo sapiens
uggucuuaaggcaaaaauuuca

SEQ ID NO: 36233 - RNA, 21 nt, Homo sapiens
aaauuuuaagggaguuucguu

SEQ ID NO: 36234 - RNA, 19 nt, Homo sapiens
aagauuucacaucuuuaca

SEQ ID NO: 36235 - RNA, 21 nt, Homo sapiens
acaaaccaauuaaguguacuu

SEQ ID NO: 36236 - RNA, 23 nt, Homo sapiens
acaaaugcaucuuucuuuuguca

SEQ ID NO: 36237 - RNA, 21 nt, Homo sapiens
acauuacuguaauuuugugua

SEQ ID NO: 36238 - RNA, 23 nt, Homo sapiens
agucccggaggaaaaagagccag

SEQ ID NO: 36239 - RNA, 17 nt, Homo sapiens
cccccguuucaggguca

SEQ ID NO: 36240 - RNA, 15 nt, Homo sapiens
gcaggacaaggcucu

SEQ ID NO: 36241 - RNA, 17 nt, Homo sapiens
ggaaacagaaacacauu

SEQ ID NO: 36242 - RNA, 20 nt, Homo sapiens
gggcaccgccccgcuccccc

SEQ ID NO: 36243 - RNA, 23 nt, Homo sapiens
ugcccaaggcagagcuguuccag

SEQ ID NO: 36244 - RNA, 20 nt, Homo sapiens
ugcccagggugcccugcccg

SEQ ID NO: 36245 - RNA, 20 nt, Homo sapiens
ccccacuguccccucacagc

SEQ ID NO: 36246 - RNA, 19 nt, Homo sapiens
ccugaguggucuuuuucau

SEQ ID NO: 36247 - RNA, 21 nt, Homo sapiens
gccgcggcggccgccaggcuu

SEQ ID NO: 36248 - RNA, 19 nt, Homo sapiens
gucuuuuucaucucuuucg

SEQ ID NO: 36249 - RNA, 21 nt, Homo sapiens
aaagaaugauaaaauaggcca

SEQ ID NO: 36250 - RNA, 20 nt, Homo sapiens
agcuagggguggccguguca

SEQ ID NO: 36251 - RNA, 22 nt, Homo sapiens
gagccaagaucaugccacugca

SEQ ID NO: 36252 - RNA, 17 nt, Homo sapiens
ucacagcccugcugucu

SEQ ID NO: 36253 - RNA, 18 nt, Homo sapiens
ucaccuccguuuugacca

SEQ ID NO: 36254 - RNA, 20 nt, Homo sapiens
ucccaggcccauagcugcaa

SEQ ID NO: 36255 - RNA, 21 nt, Homo sapiens
ugcagugagccuagaucgugc

SEQ ID NO: 36256 - RNA, 23 nt, Homo sapiens
ugcgaccaugagagaaaaaccug

SEQ ID NO: 36257 - RNA, 21 nt, Homo sapiens
aaguaacucucagaugucuua

SEQ ID NO: 36258 - RNA, 20 nt, Homo sapiens
aauagacauacacuggaaca

SEQ ID NO: 36259 - RNA, 19 nt, Homo sapiens
cgaagcuacugcggguucu

SEQ ID NO: 36260 - RNA, 17 nt, Homo sapiens
ggaguuucucaaaaucu

SEQ ID NO: 36261 - RNA, 19 nt, Homo sapiens
gguaucuaaacuugccuca

SEQ ID NO: 36262 - RNA, 17 nt, Homo sapiens
uagauagaauuuggaaa

SEQ ID NO: 36263 - RNA, 21 nt, Homo sapiens
gcguccggagucggugagcuu

SEQ ID NO: 36264 - RNA, 19 nt, Homo sapiens
uuccagaaacagaccccag

SEQ ID NO: 36265 - RNA, 18 nt, Homo sapiens
aauaguaaugaaucaaug

SEQ ID NO: 36266 - RNA, 19 nt, Homo sapiens
ggaaaguaaacagagagga

SEQ ID NO: 36267 - RNA, 15 nt, Homo sapiens
auaugaugucuauga

SEQ ID NO: 36268 - RNA, 20 nt, Homo sapiens
aucuugacacaguagaucuu

SEQ ID NO: 36269 - RNA, 19 nt, Homo sapiens
caaauaucucagugcuacu

SEQ ID NO: 36270 - RNA, 18 nt, Homo sapiens
guauuuguggaaccaauu

SEQ ID NO: 36271 - RNA, 19 nt, Homo sapiens
gugacagggguacacucuc

SEQ ID NO: 36272 - RNA, 19 nt, Homo sapiens
uaguuuugaaacucgugcc

SEQ ID NO: 36273 - RNA, 19 nt, Homo sapiens
ucaccuauacucuaccaau

SEQ ID NO: 36274 - RNA, 19 nt, Homo sapiens
ugucuucucaaacacccca

SEQ ID NO: 36275 - RNA, 24 nt, Homo sapiens
cuccauggagaagcaaacauguga

SEQ ID NO: 36276 - RNA, 20 nt, Homo sapiens
cagucccagaacaccgccua

SEQ ID NO: 36277 - RNA, 18 nt, Homo sapiens
cauuuaaaaacaauuacu

SEQ ID NO: 36278 - RNA, 19 nt, Homo sapiens
cugacacacccucuggugc

SEQ ID NO: 36279 - RNA, 22 nt, Homo sapiens
gauauugcugcuuggucucucu

SEQ ID NO: 36280 - RNA, 19 nt, Homo sapiens
ggucgccaauggcaaaaca

SEQ ID NO: 36281 - RNA, 26 nt, Homo sapiens
guggucaaaggagagagucuuuguca

SEQ ID NO: 36282 - RNA, 18 nt, Homo sapiens
uccgccuccuggguucaa

SEQ ID NO: 36283 - RNA, 20 nt, Homo sapiens
aaagugcugcauggcucgca

SEQ ID NO: 36284 - RNA, 18 nt, Homo sapiens
acagcuucaacuguucga

SEQ ID NO: 36285 - RNA, 18 nt, Homo sapiens
cacccccaccuucgcuca

SEQ ID NO: 36286 - RNA, 20 nt, Homo sapiens
ccacccucuaccccaccccc

SEQ ID NO: 36287 - RNA, 18 nt, Homo sapiens
cccacccuccccgcccca

SEQ ID NO: 36288 - RNA, 19 nt, Homo sapiens
uccccgccccagcaacugc

SEQ ID NO: 36289 - RNA, 18 nt, Homo sapiens
aaauguaauaaaauguau

SEQ ID NO: 36290 - RNA, 19 nt, Homo sapiens
agacacacucacacucuca

SEQ ID NO: 36291 - RNA, 20 nt, Homo sapiens
agagugcagaaacccgguca

SEQ ID NO: 36292 - RNA, 24 nt, Homo sapiens
cagaaaaggaagaggggcugcaga

SEQ ID NO: 36293 - RNA, 21 nt, Homo sapiens
cagaaaccagcugucugcuga

SEQ ID NO: 36294 - RNA, 19 nt, Homo sapiens
cccagcggaugccuauucc

SEQ ID NO: 36295 - RNA, 23 nt, Homo sapiens
ccuucccccuuacacuccucucc

SEQ ID NO: 36296 - RNA, 21 nt, Homo sapiens
gaccccgaguccauuggccgc

SEQ ID NO: 36297 - RNA, 21 nt, Homo sapiens
ucuacaguagcacuguggcca

SEQ ID NO: 36298 - RNA, 18 nt, Homo sapiens
ucugcugggcaucacccu

SEQ ID NO: 36299 - RNA, 18 nt, Homo sapiens
uuucuagucugcacaaua

SEQ ID NO: 36300 - RNA, 23 nt, Homo sapiens
caagaucaaagauguggguucag

SEQ ID NO: 36301 - RNA, 21 nt, Homo sapiens
caucuuaaagaagaucagaca

SEQ ID NO: 36302 - RNA, 17 nt, Homo sapiens
gaaaaagaacaacauca

SEQ ID NO: 36303 - RNA, 23 nt, Homo sapiens
agcuucugaucaacgguccugaa

SEQ ID NO: 36304 - RNA, 21 nt, Homo sapiens
augucucaauggaaacacucu

SEQ ID NO: 36305 - RNA, 22 nt, Homo sapiens
aaaauggugauggcuuauggaa

SEQ ID NO: 36306 - RNA, 21 nt, Homo sapiens
augaaccauuucaccauggca

SEQ ID NO: 36307 - RNA, 15 nt, Homo sapiens
cauuucaccauggca

SEQ ID NO: 36308 - RNA, 22 nt, Homo sapiens
gaaaccccaaauguagucucuu

SEQ ID NO: 36309 - RNA, 23 nt, Homo sapiens
gauacuacaaagccaaucuuuau

SEQ ID NO: 36310 - RNA, 20 nt, Homo sapiens
uccacuucacaugcuggaga

SEQ ID NO: 36311 - RNA, 18 nt, Homo sapiens
acuaguaggagacuguga

SEQ ID NO: 36312 - RNA, 18 nt, Homo sapiens
cccacuugcaccugccac

SEQ ID NO: 36313 - RNA, 23 nt, Homo sapiens
gcuaugauagguauuuuguguua

SEQ ID NO: 36314 - RNA, 17 nt, Homo sapiens
ucugaacaauuuccuca

SEQ ID NO: 36315 - RNA, 18 nt, Homo sapiens
uguauguggguguuucuc

SEQ ID NO: 36316 - RNA, 19 nt, Homo sapiens
acugguggcaggcuguggc

SEQ ID NO: 36317 - RNA, 18 nt, Homo sapiens
gccucagccgccucacuc

SEQ ID NO: 36318 - RNA, 18 nt, Homo sapiens
ggugcgcggugacggcua

SEQ ID NO: 36319 - RNA, 21 nt, Homo sapiens
ugugggcagcgcccugaacaa

SEQ ID NO: 36320 - RNA, 20 nt, Homo sapiens
cucuguucggagggucgcgg

SEQ ID NO: 36321 - RNA, 18 nt, Homo sapiens
gaagagcuuggaggagcc

SEQ ID NO: 36322 - RNA, 20 nt, Homo sapiens
ccagacuguuagaaaaugga

SEQ ID NO: 36323 - RNA, 22 nt, Homo sapiens
accucgacggucgccguggccc

SEQ ID NO: 36324 - RNA, 21 nt, Homo sapiens
cccccgccuccgccgccacua

SEQ ID NO: 36325 - RNA, 20 nt, Homo sapiens
cccgccuccgccgccacuau

SEQ ID NO: 36326 - RNA, 19 nt, Homo sapiens
aaguggacacauaaaauua

SEQ ID NO: 36327 - RNA, 18 nt, Homo sapiens
accuaauggugaacccca

SEQ ID NO: 36328 - RNA, 18 nt, Homo sapiens
caccaucuguguugcaag

SEQ ID NO: 36329 - RNA, 20 nt, Homo sapiens
caucauccgcuggugcuuua

SEQ ID NO: 36330 - RNA, 15 nt, Homo sapiens
ccacagcgagccucc

SEQ ID NO: 36331 - RNA, 18 nt, Homo sapiens
ccagcaccccugcaccca

SEQ ID NO: 36332 - RNA, 17 nt, Homo sapiens
ccagugauuugaucgga

SEQ ID NO: 36333 - RNA, 18 nt, Homo sapiens
cccugggucaguaccuca

SEQ ID NO: 36334 - RNA, 22 nt, Homo sapiens
cucucccuucccgagccaucug

SEQ ID NO: 36335 - RNA, 21 nt, Homo sapiens
cucugggagcaaaguggccug

SEQ ID NO: 36336 - RNA, 18 nt, Homo sapiens
gauggguucauuguggau

SEQ ID NO: 36337 - RNA, 22 nt, Homo sapiens
gccuuuugguagugaugaaaua

SEQ ID NO: 36338 - RNA, 19 nt, Homo sapiens
ucauuauccacacugcaaa

SEQ ID NO: 36339 - RNA, 19 nt, Homo sapiens
ugaguggacaccagugaag

SEQ ID NO: 36340 - RNA, 22 nt, Homo sapiens
uucuggucccggagacuugggg

SEQ ID NO: 36341 - RNA, 16 nt, Homo sapiens
uucuucugcuccaugu

SEQ ID NO: 36342 - RNA, 25 nt, Homo sapiens
gacccaggcucaggaggacugagaa

SEQ ID NO: 36343 - RNA, 22 nt, Homo sapiens
aaguccucugugggaaccccac

SEQ ID NO: 36344 - RNA, 22 nt, Homo sapiens
accccgagcugucccugccuga

SEQ ID NO: 36345 - RNA, 21 nt, Homo sapiens
caccacccccuggccuugcaa

SEQ ID NO: 36346 - RNA, 19 nt, Homo sapiens
ccgccagcacuuccacccc

SEQ ID NO: 36347 - RNA, 23 nt, Homo sapiens
gagcccuccgggaccucgagcca

SEQ ID NO: 36348 - RNA, 19 nt, Homo sapiens
uugagcacaucccaaaaga

SEQ ID NO: 36349 - RNA, 21 nt, Homo sapiens
gguuuuggcuugucacagcaa

SEQ ID NO: 36350 - RNA, 22 nt, Homo sapiens
gucaggagcugccggcggcucu

SEQ ID NO: 36351 - RNA, 25 nt, Homo sapiens
ucuaccaggacaaggcccaguccca

SEQ ID NO: 36352 - RNA, 20 nt, Homo sapiens
uggcccuccaugugagguug

SEQ ID NO: 36353 - RNA, 20 nt, Homo sapiens
aacacagcuucuaaagugug

SEQ ID NO: 36354 - RNA, 18 nt, Homo sapiens
acagguucauuuuuuuua

SEQ ID NO: 36355 - RNA, 20 nt, Homo sapiens
aguaagaggcccauuucuca

SEQ ID NO: 36356 - RNA, 18 nt, Homo sapiens
gggcggggcgcggcgccc

SEQ ID NO: 36357 - RNA, 17 nt, Homo sapiens
uugauguaauaacugcu

SEQ ID NO: 36358 - RNA, 22 nt, Homo sapiens
uuucaguaguagucuugacuuu

SEQ ID NO: 36359 - RNA, 18 nt, Homo sapiens
acuuuucuucaugucuuc

SEQ ID NO: 36360 - RNA, 20 nt, Homo sapiens
uaaucccauaacuacccucu

SEQ ID NO: 36361 - RNA, 22 nt, Homo sapiens
ucuaauuuaguaaagacccuga

SEQ ID NO: 36362 - RNA, 21 nt, Homo sapiens
acacaggagcugcagugcugu

SEQ ID NO: 36363 - RNA, 19 nt, Homo sapiens
cuuccccuacucugccucu

SEQ ID NO: 36364 - RNA, 20 nt, Homo sapiens
gcaaacaggcacuggguuuu

SEQ ID NO: 36365 - RNA, 19 nt, Homo sapiens
uuaaguaccacauucuccu

SEQ ID NO: 36366 - RNA, 24 nt, Homo sapiens
gucagagauguccccugccaugca

SEQ ID NO: 36367 - RNA, 20 nt, Homo sapiens
ucagucacuccacgcucccc

SEQ ID NO: 36368 - RNA, 19 nt, Homo sapiens
uggggucccucaggccugg

SEQ ID NO: 36369 - RNA, 23 nt, Homo sapiens
gaggaaggcuagucaauaagcua

SEQ ID NO: 36370 - RNA, 17 nt, Homo sapiens
gccccaccaccaccucc

SEQ ID NO: 36371 - RNA, 22 nt, Homo sapiens
ucccaucaguuugauucaauua

SEQ ID NO: 36372 - RNA, 21 nt, Homo sapiens
uguuauuaggaauaauccuua

SEQ ID NO: 36373 - RNA, 19 nt, Homo sapiens
cccggaacccccugcagcu

SEQ ID NO: 36374 - RNA, 22 nt, Homo sapiens
cccugggcucugaaccugugaa

SEQ ID NO: 36375 - RNA, 20 nt, Homo sapiens
ccugccccacacccaccucc

SEQ ID NO: 36376 - RNA, 22 nt, Homo sapiens
cugugaaugacaagaggagcca

SEQ ID NO: 36377 - RNA, 18 nt, Homo sapiens
gacucccccgcccccucu

SEQ ID NO: 36378 - RNA, 18 nt, Homo sapiens
gcaguggcugccuguccc

SEQ ID NO: 36379 - RNA, 22 nt, Homo sapiens
gcccagagugaccguugggcuc

SEQ ID NO: 36380 - RNA, 21 nt, Homo sapiens
gcgguggcagaggguggugag

SEQ ID NO: 36381 - RNA, 21 nt, Homo sapiens
gcuccuccuuccucugccccu

SEQ ID NO: 36382 - RNA, 19 nt, Homo sapiens
gcucuccccacgccccugc

SEQ ID NO: 36383 - RNA, 19 nt, Homo sapiens
gggcucuugucccggugga

SEQ ID NO: 36384 - RNA, 21 nt, Homo sapiens
uuccaaagagcaggacucuga

SEQ ID NO: 36385 - RNA, 16 nt, Homo sapiens
agcucugauucccaca

SEQ ID NO: 36386 - RNA, 18 nt, Homo sapiens
caucagccugccucagca

SEQ ID NO: 36387 - RNA, 16 nt, Homo sapiens
gaaagagggaaacauc

SEQ ID NO: 36388 - RNA, 23 nt, Homo sapiens
gcgccacggccgcugcugccucc

SEQ ID NO: 36389 - RNA, 23 nt, Homo sapiens
ggucaaagugaugugucuuuuag

SEQ ID NO: 36390 - RNA, 18 nt, Homo sapiens
gugggaccgucaucacca

SEQ ID NO: 36391 - RNA, 20 nt, Homo sapiens
ugauuacuuucauccaucca

SEQ ID NO: 36392 - RNA, 17 nt, Homo sapiens
cucuacuuuuaaagggu

SEQ ID NO: 36393 - RNA, 17 nt, Homo sapiens
cugaacuauacuuugaa

SEQ ID NO: 36394 - RNA, 21 nt, Homo sapiens
ucugcugauaccagugauagg

SEQ ID NO: 36395 - RNA, 25 nt, Homo sapiens
ucuguaaaaaugguugucuuaacuu

SEQ ID NO: 36396 - RNA, 21 nt, Homo sapiens
ugccaggagccggcagaccug

SEQ ID NO: 36397 - RNA, 18 nt, Homo sapiens
caugaaucaucuucccca

SEQ ID NO: 36398 - RNA, 15 nt, Homo sapiens
cucauuguuaugaug

SEQ ID NO: 36399 - RNA, 23 nt, Homo sapiens
cuucaccgcugcucaccaccaca

SEQ ID NO: 36400 - RNA, 18 nt, Homo sapiens
aaggcgcuuggcuugguu

SEQ ID NO: 36401 - RNA, 19 nt, Homo sapiens
aucuuggucuguaccccuc

SEQ ID NO: 36402 - RNA, 24 nt, Homo sapiens
cguccccgcuuccuagcugcccac

SEQ ID NO: 36403 - RNA, 21 nt, Homo sapiens
auccccucggcccugcugcuc

SEQ ID NO: 36404 - RNA, 19 nt, Homo sapiens
ccacggcccuggcugcccc

SEQ ID NO: 36405 - RNA, 21 nt, Homo sapiens
cccugugcugggggccuugag

SEQ ID NO: 36406 - RNA, 18 nt, Homo sapiens
cugggcagggaggccaga

SEQ ID NO: 36407 - RNA, 18 nt, Homo sapiens
uuccacaguccugggcug

SEQ ID NO: 36408 - RNA, 18 nt, Homo sapiens
acagugcugcggcugcuu

SEQ ID NO: 36409 - RNA, 24 nt, Homo sapiens
augccuauagucccugcaacucug

SEQ ID NO: 36410 - RNA, 20 nt, Homo sapiens
caaaauugcaccacugcacu

SEQ ID NO: 36411 - RNA, 20 nt, Homo sapiens
cagcugguauuuggacaaca

SEQ ID NO: 36412 - RNA, 16 nt, Homo sapiens
ccagaggcgccaggca

SEQ ID NO: 36413 - RNA, 20 nt, Homo sapiens
ccuccagcacagcuucacca

SEQ ID NO: 36414 - RNA, 18 nt, Homo sapiens
ccuugucaccauguugag

SEQ ID NO: 36415 - RNA, 15 nt, Homo sapiens
cucaggcagcugcag

SEQ ID NO: 36416 - RNA, 16 nt, Homo sapiens
cuccagcacagcuuca

SEQ ID NO: 36417 - RNA, 20 nt, Homo sapiens
uggccacccccuccaucucu

SEQ ID NO: 36418 - RNA, 18 nt, Homo sapiens
ugggcccagguucccacc

SEQ ID NO: 36419 - RNA, 17 nt, Homo sapiens
acuuccagcagcaccaa

SEQ ID NO: 36420 - RNA, 16 nt, Homo sapiens
aggccgcugugugugg

SEQ ID NO: 36421 - RNA, 20 nt, Homo sapiens
gggcuucgaagccuucauca

SEQ ID NO: 36422 - RNA, 16 nt, Homo sapiens
ugaagauuaccaguua

SEQ ID NO: 36423 - RNA, 20 nt, Homo sapiens
uucacaaacagccucuguca

SEQ ID NO: 36424 - RNA, 22 nt, Homo sapiens
aaaugcaauaucuggguacugu

SEQ ID NO: 36425 - RNA, 19 nt, Homo sapiens
aagguggacaucuucacga

SEQ ID NO: 36426 - RNA, 22 nt, Homo sapiens
accucacugucaucugccagga

SEQ ID NO: 36427 - RNA, 16 nt, Homo sapiens
agcaacaaauauguca

SEQ ID NO: 36428 - RNA, 18 nt, Homo sapiens
auguauuuauugcaaugu

SEQ ID NO: 36429 - RNA, 20 nt, Homo sapiens
cuuuuuguaagucuuuauua

SEQ ID NO: 36430 - RNA, 21 nt, Homo sapiens
gaaaaagguuuuuccccuugu

SEQ ID NO: 36431 - RNA, 17 nt, Homo sapiens
gaaauauauacugcuuu

SEQ ID NO: 36432 - RNA, 23 nt, Homo sapiens
gagccacggugccaggaccaucu

SEQ ID NO: 36433 - RNA, 19 nt, Homo sapiens
uaauacagucuuguuuguc

SEQ ID NO: 36434 - RNA, 20 nt, Homo sapiens
uacugaacacaauaaugcug

SEQ ID NO: 36435 - RNA, 21 nt, Homo sapiens
ucaccaaaugaccuuaccugu

SEQ ID NO: 36436 - RNA, 24 nt, Homo sapiens
ucuuggugagagaaugaauggugu

SEQ ID NO: 36437 - RNA, 21 nt, Homo sapiens
ugaugggaugguguugauaua

SEQ ID NO: 36438 - RNA, 18 nt, Homo sapiens
uucaucugccacugguua

SEQ ID NO: 36439 - RNA, 21 nt, Homo sapiens
gcgcagcggagcggggcagag

SEQ ID NO: 36440 - RNA, 19 nt, Homo sapiens
uggacccgccgcagagcca

SEQ ID NO: 36441 - RNA, 18 nt, Homo sapiens
cuuuccagaguaccccag

SEQ ID NO: 36442 - RNA, 19 nt, Homo sapiens
gccaguggcugcuuguucu

SEQ ID NO: 36443 - RNA, 19 nt, Homo sapiens
agacacugaguuuuccuua

SEQ ID NO: 36444 - RNA, 21 nt, Homo sapiens
caccacccaccaccccacccu

SEQ ID NO: 36445 - RNA, 17 nt, Homo sapiens
cacccaaaccugucuac

SEQ ID NO: 36446 - RNA, 19 nt, Homo sapiens
cacccucuccaggccucaa

SEQ ID NO: 36447 - RNA, 18 nt, Homo sapiens
ccagcuggcccagccccu

SEQ ID NO: 36448 - RNA, 23 nt, Homo sapiens
cuccuacccaggcccaccacugg

SEQ ID NO: 36449 - RNA, 24 nt, Homo sapiens
gacccacccugcucucuggcccca

SEQ ID NO: 36450 - RNA, 22 nt, Homo sapiens
guccuuggacccagcuggccca

SEQ ID NO: 36451 - RNA, 18 nt, Homo sapiens
uuccagagggcaugccag

SEQ ID NO: 36452 - RNA, 25 nt, Homo sapiens
aaggaucaggucaacacggaccuca

SEQ ID NO: 36453 - RNA, 23 nt, Homo sapiens
caggcaucagauuguuuucguca

SEQ ID NO: 36454 - RNA, 16 nt, Homo sapiens
cugauccacuccaccu

SEQ ID NO: 36455 - RNA, 19 nt, Homo sapiens
cugcaaccuccgccuccca

SEQ ID NO: 36456 - RNA, 23 nt, Homo sapiens
gcugggucucagaugcaaccuca

SEQ ID NO: 36457 - RNA, 23 nt, Homo sapiens
gcuugagccacugcgccuggccu

SEQ ID NO: 36458 - RNA, 25 nt, Homo sapiens
uaccuaagaaagcucaaggcugcca

SEQ ID NO: 36459 - RNA, 18 nt, Homo sapiens
ucaguggaauaucauaca

SEQ ID NO: 36460 - RNA, 18 nt, Homo sapiens
uccgccucccagguucaa

SEQ ID NO: 36461 - RNA, 17 nt, Homo sapiens
ugaugccccugauggca

SEQ ID NO: 36462 - RNA, 19 nt, Homo sapiens
agcaucgagggcgagggga

SEQ ID NO: 36463 - RNA, 18 nt, Homo sapiens
cauguguacaucaugcga

SEQ ID NO: 36464 - RNA, 18 nt, Homo sapiens
ccuccaggaaaucuugag

SEQ ID NO: 36465 - RNA, 24 nt, Homo sapiens
cgugugcaaauaugacucaauuca

SEQ ID NO: 36466 - RNA, 19 nt, Homo sapiens
cugaacugucaucauuccu

SEQ ID NO: 36467 - RNA, 18 nt, Homo sapiens
gggagcgccaucugugug

SEQ ID NO: 36468 - RNA, 21 nt, Homo sapiens
uccauucugacaucugggcug

SEQ ID NO: 36469 - RNA, 18 nt, Homo sapiens
uguacccccauucucuga

SEQ ID NO: 36470 - RNA, 22 nt, Homo sapiens
uuuguagucauuccaaguggua

SEQ ID NO: 36471 - RNA, 26 nt, Homo sapiens
cggguaaagaaguuaaaguaccacca

SEQ ID NO: 36472 - RNA, 18 nt, Homo sapiens
caccauucuccugccuca

SEQ ID NO: 36473 - RNA, 17 nt, Homo sapiens
cccggggcccccccagc

SEQ ID NO: 36474 - RNA, 19 nt, Homo sapiens
ccugggucccgccuagccu

SEQ ID NO: 36475 - RNA, 19 nt, Homo sapiens
cugcaagcuccgccuccca

SEQ ID NO: 36476 - RNA, 19 nt, Homo sapiens
cuugaugagcugcugcgag

SEQ ID NO: 36477 - RNA, 22 nt, Homo sapiens
gccucacggaagggcccggugg

SEQ ID NO: 36478 - RNA, 22 nt, Homo sapiens
gcgccagggacaccaggaauuc

SEQ ID NO: 36479 - RNA, 23 nt, Homo sapiens
gcgucccaggacgcccgcuuccu

SEQ ID NO: 36480 - RNA, 18 nt, Homo sapiens
gcuauacgacuucacauc

SEQ ID NO: 36481 - RNA, 18 nt, Homo sapiens
ggccugaccgccaccccu

SEQ ID NO: 36482 - RNA, 22 nt, Homo sapiens
cagagaguuaagaggcgcccaa

SEQ ID NO: 36483 - RNA, 15 nt, Homo sapiens
cucuaaauagagcca

SEQ ID NO: 36484 - RNA, 20 nt, Homo sapiens
gcagaggaccguuuccuuuu

SEQ ID NO: 36485 - RNA, 24 nt, Homo sapiens
gcugcgggaggggacggcacccca

SEQ ID NO: 36486 - RNA, 23 nt, Homo sapiens
accugacaaccauguguacacca

SEQ ID NO: 36487 - RNA, 22 nt, Homo sapiens
cagacagagcccucuagcugcu

SEQ ID NO: 36488 - RNA, 15 nt, Homo sapiens
ccaucuacaacagca

SEQ ID NO: 36489 - RNA, 19 nt, Homo sapiens
ccgcggcuggcugacaccu

SEQ ID NO: 36490 - RNA, 21 nt, Homo sapiens
cgggacgguggcucugcagug

SEQ ID NO: 36491 - RNA, 22 nt, Homo sapiens
agaagucucauguugcauuuuc

SEQ ID NO: 36492 - RNA, 19 nt, Homo sapiens
ggcaggcauggcggccccu

SEQ ID NO: 36493 - RNA, 26 nt, Homo sapiens
ugacauccuggcuccucaucuucuuc

SEQ ID NO: 36494 - RNA, 17 nt, Homo sapiens
uuuccuaacggcaggca

SEQ ID NO: 36495 - RNA, 23 nt, Homo sapiens
uuuguuuuuuugauuuuugaugu

SEQ ID NO: 36496 - RNA, 21 nt, Homo sapiens
uaugacucucacccaugucau

SEQ ID NO: 36497 - RNA, 18 nt, Homo sapiens
ugacucucacccauguca

SEQ ID NO: 36498 - RNA, 21 nt, Homo sapiens
uuugugaaugauaguuucaca

SEQ ID NO: 36499 - RNA, 21 nt, Homo sapiens
aaaacuuuuaaaaaauacauu

SEQ ID NO: 36500 - RNA, 18 nt, Homo sapiens
ccuuaauuacauuuaaug

SEQ ID NO: 36501 - RNA, 21 nt, Homo sapiens
ugaagaacuuuguuuacauca

SEQ ID NO: 36502 - RNA, 21 nt, Homo sapiens
ugauuauauuugccucugaua

SEQ ID NO: 36503 - RNA, 23 nt, Homo sapiens
cccagggccuggcccuaccuccu

SEQ ID NO: 36504 - RNA, 18 nt, Homo sapiens
ccugcaaccuccaccucc

SEQ ID NO: 36505 - RNA, 19 nt, Homo sapiens
cugcaaccuccaccuccca

SEQ ID NO: 36506 - RNA, 18 nt, Homo sapiens
uccaccucccagguucaa

SEQ ID NO: 36507 - RNA, 17 nt, Homo sapiens
auuacaaauagaagcuu

SEQ ID NO: 36508 - RNA, 23 nt, Homo sapiens
ccuguaccucucucugcuccuca

SEQ ID NO: 36509 - RNA, 17 nt, Homo sapiens
ugacugggaaggacaua

SEQ ID NO: 36510 - RNA, 16 nt, Homo sapiens
cccagccccgcgcagc

SEQ ID NO: 36511 - RNA, 18 nt, Homo sapiens
aaaguaggaaucuggcag

SEQ ID NO: 36512 - RNA, 23 nt, Homo sapiens
ggcacaugccuguaauccgagug

SEQ ID NO: 36513 - RNA, 21 nt, Homo sapiens
ugaucuguaccaggucaccca

SEQ ID NO: 36514 - RNA, 20 nt, Homo sapiens
aaaaaggaaaaugguuuccc

SEQ ID NO: 36515 - RNA, 21 nt, Homo sapiens
uucagagcuugaagcauccaa

SEQ ID NO: 36516 - RNA, 23 nt, Homo sapiens
aaaaaaaaauuugcuggguguca

SEQ ID NO: 36517 - RNA, 24 nt, Homo sapiens
agugaaugggacucaaauguugug

SEQ ID NO: 36518 - RNA, 17 nt, Homo sapiens
ccaccucccucacccuc

SEQ ID NO: 36519 - RNA, 20 nt, Homo sapiens
cccccggagccgccgcgcca

SEQ ID NO: 36520 - RNA, 19 nt, Homo sapiens
ccuccugcccggggcuguu

SEQ ID NO: 36521 - RNA, 19 nt, Homo sapiens
ggcggacggcggcgacggc

SEQ ID NO: 36522 - RNA, 19 nt, Homo sapiens
ucugacacaauaucccuca

SEQ ID NO: 36523 - RNA, 22 nt, Homo sapiens
ucuucuucacuugaacuuugua

SEQ ID NO: 36524 - RNA, 22 nt, Homo sapiens
acuuccaaaaccagccaccgcu

SEQ ID NO: 36525 - RNA, 18 nt, Homo sapiens
ccacacacacacacacaa

SEQ ID NO: 36526 - RNA, 30 nt, Homo sapiens
auggauggagacuuuccaaauauggaacua

SEQ ID NO: 36527 - RNA, 21 nt, Homo sapiens
cacccagcagcagaccaacca

SEQ ID NO: 36528 - RNA, 21 nt, Homo sapiens
ccuguauacccagauuacuuu

SEQ ID NO: 36529 - RNA, 19 nt, Homo sapiens
gcccuucauggcucugcac

SEQ ID NO: 36530 - RNA, 18 nt, Homo sapiens
uauguuugaccaaggcac

SEQ ID NO: 36531 - RNA, 25 nt, Homo sapiens
ucuggugugguuggaggucugugga

SEQ ID NO: 36532 - RNA, 17 nt, Homo sapiens
acugcagaauuacuauu

SEQ ID NO: 36533 - RNA, 21 nt, Homo sapiens
aguuguagucauuuuuuuccc

SEQ ID NO: 36534 - RNA, 21 nt, Homo sapiens
cagcaucuaacuaaauccuca

SEQ ID NO: 36535 - RNA, 20 nt, Homo sapiens
ggggcugucuggcucgguua

SEQ ID NO: 36536 - RNA, 21 nt, Homo sapiens
uucugcugggcacgguggcuc

SEQ ID NO: 36537 - RNA, 18 nt, Homo sapiens
caagaacacaaggagcau

SEQ ID NO: 36538 - RNA, 17 nt, Homo sapiens
caguuggauuuaugaua

SEQ ID NO: 36539 - RNA, 20 nt, Homo sapiens
gucaugaaaaccagaacagu

SEQ ID NO: 36540 - RNA, 19 nt, Homo sapiens
uuucuuuaauaugugacca

SEQ ID NO: 36541 - RNA, 17 nt, Homo sapiens
cugucacugacaucaca

SEQ ID NO: 36542 - RNA, 18 nt, Homo sapiens
ggagcucugcaagucuca

SEQ ID NO: 36543 - RNA, 18 nt, Homo sapiens
uccaagaaucugcacuga

SEQ ID NO: 36544 - RNA, 16 nt, Homo sapiens
ucuugccccagauucu

SEQ ID NO: 36545 - RNA, 20 nt, Homo sapiens
ccaccuccaccuccaccucc

SEQ ID NO: 36546 - RNA, 20 nt, Homo sapiens
ccgauuccaccuccaccucc

SEQ ID NO: 36547 - RNA, 17 nt, Homo sapiens
ccugccccgcccacuuu

SEQ ID NO: 36548 - RNA, 18 nt, Homo sapiens
ggccagacaaccucaggg

SEQ ID NO: 36549 - RNA, 27 nt, Homo sapiens
ucccagagcgccccgagggggcagcga

SEQ ID NO: 36550 - RNA, 19 nt, Homo sapiens
ugcccaaggccaaccuccu

SEQ ID NO: 36551 - RNA, 16 nt, Homo sapiens
aggugaagaauccucc

SEQ ID NO: 36552 - RNA, 22 nt, Homo sapiens
caaacaggaugcaacugcagug

SEQ ID NO: 36553 - RNA, 23 nt, Homo sapiens
ccugcccucaccugugggcaaca

SEQ ID NO: 36554 - RNA, 23 nt, Homo sapiens
uacauucaaaagcucaaaggcua

SEQ ID NO: 36555 - RNA, 18 nt, Homo sapiens
uuccuuggauguguaguu

SEQ ID NO: 36556 - RNA, 18 nt, Homo sapiens
cccacugccacuccgaca

SEQ ID NO: 36557 - RNA, 18 nt, Homo sapiens
cagaauucauucugcucc

SEQ ID NO: 36558 - RNA, 19 nt, Homo sapiens
gccugcucuggaccaggga

SEQ ID NO: 36559 - RNA, 22 nt, Homo sapiens
accugggagcgcugcuuggcuc

SEQ ID NO: 36560 - RNA, 18 nt, Homo sapiens
cacucuaucugccauuca

SEQ ID NO: 36561 - RNA, 22 nt, Homo sapiens
guagcuucaguauguuuccuca

SEQ ID NO: 36562 - RNA, 22 nt, Homo sapiens
uuuggcuggcagaaauuaucua

SEQ ID NO: 36563 - RNA, 19 nt, Homo sapiens
aaggucacuagccuugcca

SEQ ID NO: 36564 - RNA, 18 nt, Homo sapiens
acaaaaguuaucaaagag

SEQ ID NO: 36565 - RNA, 18 nt, Homo sapiens
ccccccccgcucuuucca

SEQ ID NO: 36566 - RNA, 18 nt, Homo sapiens
ccuccgcccggcagccgc

SEQ ID NO: 36567 - RNA, 23 nt, Homo sapiens
ccucuccgcccagcagccaccuc

SEQ ID NO: 36568 - RNA, 19 nt, Homo sapiens
cgcuacaaccuccaccucc

SEQ ID NO: 36569 - RNA, 18 nt, Homo sapiens
cugccuggcaacugcccc

SEQ ID NO: 36570 - RNA, 18 nt, Homo sapiens
cuuucucucuccuuagug

SEQ ID NO: 36571 - RNA, 17 nt, Homo sapiens
gauugcccuuuacaguu

SEQ ID NO: 36572 - RNA, 18 nt, Homo sapiens
ugcccggccgccauccca

SEQ ID NO: 36573 - RNA, 23 nt, Homo sapiens
ugguaccugaguuauaccccugg

SEQ ID NO: 36574 - RNA, 26 nt, Homo sapiens
ccuuuucacucccauuccuuagcuuu

SEQ ID NO: 36575 - RNA, 21 nt, Homo sapiens
ugagguuucaauaaacaguuu

SEQ ID NO: 36576 - RNA, 17 nt, Homo sapiens
acagggagaggcgaccc

SEQ ID NO: 36577 - RNA, 20 nt, Homo sapiens
gacccugccgccuucuucgu

SEQ ID NO: 36578 - RNA, 21 nt, Homo sapiens
uaggauuguguuucuuaguca

SEQ ID NO: 36579 - RNA, 21 nt, Homo sapiens
uccugaacuuccuguaccaca

SEQ ID NO: 36580 - RNA, 20 nt, Homo sapiens
ucugagcaguuuucugaauu

SEQ ID NO: 36581 - RNA, 23 nt, Homo sapiens
ugcaauuuuaaaaccugugcugc

SEQ ID NO: 36582 - RNA, 23 nt, Homo sapiens
ugcaauuuuaaaaccugugcugc

SEQ ID NO: 36583 - RNA, 18 nt, Homo sapiens
ugcccucaaaugcaccca

SEQ ID NO: 36584 - RNA, 19 nt, Homo sapiens
agucuuacucagcuaucca

SEQ ID NO: 36585 - RNA, 22 nt, Homo sapiens
cgagauucaaaucuccgauucc

SEQ ID NO: 36586 - RNA, 18 nt, Homo sapiens
uaaugaaacuguguguac

SEQ ID NO: 36587 - RNA, 17 nt, Homo sapiens
ugcauuccaagcuuuuu

SEQ ID NO: 36588 - RNA, 19 nt, Homo sapiens
uagagaaacacagauucuu

SEQ ID NO: 36589 - RNA, 20 nt, Homo sapiens
ucugaagacaauggacccac

SEQ ID NO: 36590 - RNA, 16 nt, Homo sapiens
caugagggugugguca

SEQ ID NO: 36591 - RNA, 22 nt, Homo sapiens
ccaauuaaaagguggcccaaca

SEQ ID NO: 36592 - RNA, 23 nt, Homo sapiens
cccggcuguggcgcuucugugga

SEQ ID NO: 36593 - RNA, 18 nt, Homo sapiens
cuuccagaagcaacccag

SEQ ID NO: 36594 - RNA, 17 nt, Homo sapiens
ucauugaauucugguga

SEQ ID NO: 36595 - RNA, 17 nt, Homo sapiens
uugguuguacuaugaaa

SEQ ID NO: 36596 - RNA, 16 nt, Homo sapiens
ucaaacagauguugua

SEQ ID NO: 36597 - RNA, 18 nt, Homo sapiens
ugcugaggugacuguuga

SEQ ID NO: 36598 - RNA, 20 nt, Homo sapiens
cagcaggacuguacgaggaa

SEQ ID NO: 36599 - RNA, 18 nt, Homo sapiens
gaaguguggugaaggugg

SEQ ID NO: 36600 - RNA, 20 nt, Homo sapiens
gcaguuucaggggagguguc

SEQ ID NO: 36601 - RNA, 25 nt, Homo sapiens
aaaggccaaugucuucuagcugcuu

SEQ ID NO: 36602 - RNA, 22 nt, Homo sapiens
cccacugccacauaccucuguu

SEQ ID NO: 36603 - RNA, 22 nt, Homo sapiens
gacgggguuucaccaugcuggc

SEQ ID NO: 36604 - RNA, 19 nt, Homo sapiens
gcaaugcacagccacuucc

SEQ ID NO: 36605 - RNA, 19 nt, Homo sapiens
ggaaaucaaccaggaccaa

SEQ ID NO: 36606 - RNA, 19 nt, Homo sapiens
uguguaugaguuuugucug

SEQ ID NO: 36607 - RNA, 27 nt, Homo sapiens
augucacuucagaaacuuccugcccua

SEQ ID NO: 36608 - RNA, 20 nt, Homo sapiens
ucccaaacguguuccaacaa

SEQ ID NO: 36609 - RNA, 18 nt, Homo sapiens
ugcagcugcaccuaagca

SEQ ID NO: 36610 - RNA, 16 nt, Homo sapiens
ucaaacagauguugua

SEQ ID NO: 36611 - RNA, 18 nt, Homo sapiens
ugcugaggugacuguuga

SEQ ID NO: 36612 - RNA, 16 nt, Homo sapiens
cugcuuuggaggcugc

SEQ ID NO: 36613 - RNA, 23 nt, Homo sapiens
gaagccauccugcagcucugaga

SEQ ID NO: 36614 - RNA, 18 nt, Homo sapiens
auuucaggggucuaccgg

SEQ ID NO: 36615 - RNA, 18 nt, Homo sapiens
agucaaggucaaggucag

SEQ ID NO: 36616 - RNA, 20 nt, Homo sapiens
uucaagaccagccugaccaa

SEQ ID NO: 36617 - RNA, 21 nt, Homo sapiens
ucagguauaauaaucauuguu

SEQ ID NO: 36618 - RNA, 23 nt, Homo sapiens
uaaaccuaugaaaaauccuugcu

SEQ ID NO: 36619 - RNA, 20 nt, Homo sapiens
uuuuggaaguaaucauaacu

SEQ ID NO: 36620 - RNA, 23 nt, Homo sapiens
gucacugccaacuuggugacuca

SEQ ID NO: 36621 - RNA, 21 nt, Homo sapiens
gccugcugaggggaggggagc

SEQ ID NO: 36622 - RNA, 26 nt, Homo sapiens
cuccaaucuugguccguauuuccaaa

SEQ ID NO: 36623 - RNA, 16 nt, Homo sapiens
ucuugguccguauuuc

SEQ ID NO: 36624 - RNA, 24 nt, Homo sapiens
ugagugggcugagcauguagacua

SEQ ID NO: 36625 - RNA, 22 nt, Homo sapiens
augugaauauagaaauauuuca

SEQ ID NO: 36626 - RNA, 19 nt, Homo sapiens
ccagucauguuauuucuuu

SEQ ID NO: 36627 - RNA, 21 nt, Homo sapiens
cacuugugcccccagcucagc

SEQ ID NO: 36628 - RNA, 18 nt, Homo sapiens
ccuggugacggggcuggc

SEQ ID NO: 36629 - RNA, 16 nt, Homo sapiens
gcgccuagggcugcgg

SEQ ID NO: 36630 - RNA, 23 nt, Homo sapiens
aaaaauuacacaaaacuagaaua

SEQ ID NO: 36631 - RNA, 21 nt, Homo sapiens
aucugugugugcguguuugug

SEQ ID NO: 36632 - RNA, 20 nt, Homo sapiens
augcauaagcuauauacuuc

SEQ ID NO: 36633 - RNA, 20 nt, Homo sapiens
auguuacuugcuaucauucc

SEQ ID NO: 36634 - RNA, 20 nt, Homo sapiens
auuaaagguaucacaaaaua

SEQ ID NO: 36635 - RNA, 18 nt, Homo sapiens
caacauccagaucugaca

SEQ ID NO: 36636 - RNA, 18 nt, Homo sapiens
ccacuggaaauuauuuug

SEQ ID NO: 36637 - RNA, 22 nt, Homo sapiens
cuaucucugggcuacaguauua

SEQ ID NO: 36638 - RNA, 21 nt, Homo sapiens
cuucuuuggcauucuugaccu

SEQ ID NO: 36639 - RNA, 20 nt, Homo sapiens
gacacagugaccucugugga

SEQ ID NO: 36640 - RNA, 18 nt, Homo sapiens
gaccucagaacuaucucu

SEQ ID NO: 36641 - RNA, 19 nt, Homo sapiens
uaacugauguaaccauuga

SEQ ID NO: 36642 - RNA, 26 nt, Homo sapiens
uaucuaugcaguuuauauaaacuaca

SEQ ID NO: 36643 - RNA, 17 nt, Homo sapiens
uauguauucugaccuca

SEQ ID NO: 36644 - RNA, 20 nt, Homo sapiens
ucaaacagugccaacacuca

SEQ ID NO: 36645 - RNA, 22 nt, Homo sapiens
ucacucauguuguggcuuauuu

SEQ ID NO: 36646 - RNA, 20 nt, Homo sapiens
uguuagcuacuuugagaacc

SEQ ID NO: 36647 - RNA, 18 nt, Homo sapiens
ccaaauaccuauguaaua

SEQ ID NO: 36648 - RNA, 27 nt, Homo sapiens
ccaugaggauaaauaucuaacacuuuu

SEQ ID NO: 36649 - RNA, 22 nt, Homo sapiens
ucucuuucauuguuacuuugua

SEQ ID NO: 36650 - RNA, 19 nt, Homo sapiens
cuuggagcugucuuaaucu

SEQ ID NO: 36651 - RNA, 24 nt, Homo sapiens
guggguggggggagcuuggagcug

SEQ ID NO: 36652 - RNA, 20 nt, Homo sapiens
uccuagcugguuccagcaaa

SEQ ID NO: 36653 - RNA, 21 nt, Homo sapiens
ggccgggcgcgcgccauccug

SEQ ID NO: 36654 - RNA, 18 nt, Homo sapiens
ggcggcggcggccgcggc

SEQ ID NO: 36655 - RNA, 18 nt, Homo sapiens
gaacccacacugcagugg

SEQ ID NO: 36656 - RNA, 20 nt, Homo sapiens
gccggugcuaccaggaguca

SEQ ID NO: 36657 - RNA, 18 nt, Homo sapiens
ucagcaguauauacauca

SEQ ID NO: 36658 - RNA, 22 nt, Homo sapiens
uguggggguggugggguacagg

SEQ ID NO: 36659 - RNA, 17 nt, Homo sapiens
caaaccuuuagcucacu

SEQ ID NO: 36660 - RNA, 21 nt, Homo sapiens
uuugccuacaugguguauuua

SEQ ID NO: 36661 - RNA, 22 nt, Homo sapiens
cacguccugcucccccugguga

SEQ ID NO: 36662 - RNA, 22 nt, Homo sapiens
aguuuucacuuuacuacaguga

SEQ ID NO: 36663 - RNA, 23 nt, Homo sapiens
auguugguuugauacuguuaaca

SEQ ID NO: 36664 - RNA, 22 nt, Homo sapiens
cuucugaguacucaaucaauca

SEQ ID NO: 36665 - RNA, 22 nt, Homo sapiens
gggaccgcggggcagccagggc

SEQ ID NO: 36666 - RNA, 19 nt, Homo sapiens
ugauacuguuaacacacca

SEQ ID NO: 36667 - RNA, 21 nt, Homo sapiens
aucuuacuuacccagaacucu

SEQ ID NO: 36668 - RNA, 15 nt, Homo sapiens
ccugaacucagcaga

SEQ ID NO: 36669 - RNA, 18 nt, Homo sapiens
acacuuccuagauaacgg

SEQ ID NO: 36670 - RNA, 17 nt, Homo sapiens
gcgauucaccugccuca

SEQ ID NO: 36671 - RNA, 20 nt, Homo sapiens
uggccaggcuggucuugaac

SEQ ID NO: 36672 - RNA, 19 nt, Homo sapiens
uaccguugaauuuaccguu

SEQ ID NO: 36673 - RNA, 18 nt, Homo sapiens
ggaauuugguauggaauu

SEQ ID NO: 36674 - RNA, 25 nt, Homo sapiens
acuugagcaauuucugucuuggccu

SEQ ID NO: 36675 - RNA, 18 nt, Homo sapiens
ccggcauuucuccgccuc

SEQ ID NO: 36676 - RNA, 22 nt, Homo sapiens
cucaaaaaaguucacuugcaca

SEQ ID NO: 36677 - RNA, 20 nt, Homo sapiens
cuuaguggacagacuccaca

SEQ ID NO: 36678 - RNA, 18 nt, Homo sapiens
gaaauuccuguccaucca

SEQ ID NO: 36679 - RNA, 16 nt, Homo sapiens
gaagacaacaucuaca

SEQ ID NO: 36680 - RNA, 16 nt, Homo sapiens
uuugauuuccaauaca

SEQ ID NO: 36681 - RNA, 27 nt, Homo sapiens
gacgugucgcgaaaugcacacgaaguc

SEQ ID NO: 36682 - RNA, 22 nt, Homo sapiens
accugaguucuaggccuggcuc

SEQ ID NO: 36683 - RNA, 18 nt, Homo sapiens
agagagguaugggaccug

SEQ ID NO: 36684 - RNA, 17 nt, Homo sapiens
caggaacgccccgccgc

SEQ ID NO: 36685 - RNA, 19 nt, Homo sapiens
acaucuuuauucccuucuu

SEQ ID NO: 36686 - RNA, 18 nt, Homo sapiens
agucagugacagaccuca

SEQ ID NO: 36687 - RNA, 17 nt, Homo sapiens
aucuccuaaugaugaug

SEQ ID NO: 36688 - RNA, 21 nt, Homo sapiens
cauguauuugugugacaggga

SEQ ID NO: 36689 - RNA, 21 nt, Homo sapiens
cccucuucugcuucucaguga

SEQ ID NO: 36690 - RNA, 19 nt, Homo sapiens
gggauagaauggcggccug

SEQ ID NO: 36691 - RNA, 21 nt, Homo sapiens
ugaagggacauucugccauga

SEQ ID NO: 36692 - RNA, 21 nt, Homo sapiens
uuugcuaagcaaugcaugacu

SEQ ID NO: 36693 - RNA, 19 nt, Homo sapiens
guuuuggccaggcagucaa

SEQ ID NO: 36694 - RNA, 22 nt, Homo sapiens
acggcgagaacccggcccugcu

SEQ ID NO: 36695 - RNA, 20 nt, Homo sapiens
gaccccgauggcggcgccgg

SEQ ID NO: 36696 - RNA, 15 nt, Homo sapiens
acauguaacaucaca

SEQ ID NO: 36697 - RNA, 23 nt, Homo sapiens
aggaucauuuaaugacuguuuua

SEQ ID NO: 36698 - RNA, 19 nt, Homo sapiens
augucacugagugaaugau

SEQ ID NO: 36699 - RNA, 17 nt, Homo sapiens
cauaucuucuucacccu

SEQ ID NO: 36700 - RNA, 22 nt, Homo sapiens
uaaaguucuccagauggagcua

SEQ ID NO: 36701 - RNA, 20 nt, Homo sapiens
ugacuguuuucucaugugcc

SEQ ID NO: 36702 - RNA, 18 nt, Homo sapiens
aucaaggaacaacuauca

SEQ ID NO: 36703 - RNA, 20 nt, Homo sapiens
cagcaaaauaagaaaaaaua

SEQ ID NO: 36704 - RNA, 21 nt, Homo sapiens
ccaacaagaugugccaguuga

SEQ ID NO: 36705 - RNA, 21 nt, Homo sapiens
cccuuuuuccuuacaguaaca

SEQ ID NO: 36706 - RNA, 20 nt, Homo sapiens
cugacuguacuauccacuga

SEQ ID NO: 36707 - RNA, 19 nt, Homo sapiens
gcuacaacugagcaaaaua

SEQ ID NO: 36708 - RNA, 22 nt, Homo sapiens
guagcauggguucacuuggcua

SEQ ID NO: 36709 - RNA, 22 nt, Homo sapiens
ucacuuggcuacaacugagcaa

SEQ ID NO: 36710 - RNA, 26 nt, Homo sapiens
acuuucagaaagaauaaacuuucuca

SEQ ID NO: 36711 - RNA, 19 nt, Homo sapiens
uaauacagugggucaaaua

SEQ ID NO: 36712 - RNA, 17 nt, Homo sapiens
uuucuauauugaaauau

SEQ ID NO: 36713 - RNA, 21 nt, Homo sapiens
agccuggcuacuuuugccuca

SEQ ID NO: 36714 - RNA, 20 nt, Homo sapiens
cagcugaccuuuucauuaua

SEQ ID NO: 36715 - RNA, 22 nt, Homo sapiens
uggccagaaacauacagagggg

SEQ ID NO: 36716 - RNA, 21 nt, Homo sapiens
accggagucacaguucccgca

SEQ ID NO: 36717 - RNA, 19 nt, Homo sapiens
cuucuacugcucugauuuu

SEQ ID NO: 36718 - RNA, 18 nt, Homo sapiens
guugaaagaauuaugaaa

SEQ ID NO: 36719 - RNA, 22 nt, Homo sapiens
uuuggagaggcagaugacauua

SEQ ID NO: 36720 - RNA, 22 nt, Homo sapiens
ccuuccccagggcuccuucuca

SEQ ID NO: 36721 - RNA, 21 nt, Homo sapiens
cugcaccaggcguccugggga

SEQ ID NO: 36722 - RNA, 17 nt, Homo sapiens
gugaagacgacacuggg

SEQ ID NO: 36723 - RNA, 17 nt, Homo sapiens
cuaagugacagcuguua

SEQ ID NO: 36724 - RNA, 22 nt, Homo sapiens
uuaaaaaugaacggugauuugg

SEQ ID NO: 36725 - RNA, 21 nt, Homo sapiens
aaacccaaacaaaacaaaaca

SEQ ID NO: 36726 - RNA, 18 nt, Homo sapiens
acaggcgccaccaccuug

SEQ ID NO: 36727 - RNA, 20 nt, Homo sapiens
agucucacucugucgcccag

SEQ ID NO: 36728 - RNA, 21 nt, Homo sapiens
aucuuggcuuacugcaaccuc

SEQ ID NO: 36729 - RNA, 18 nt, Homo sapiens
cgcaagcuccgcuuccca

SEQ ID NO: 36730 - RNA, 19 nt, Homo sapiens
cugcaaccuccaccuccca

SEQ ID NO: 36731 - RNA, 18 nt, Homo sapiens
uccaccucccagguucaa

SEQ ID NO: 36732 - RNA, 20 nt, Homo sapiens
uggccaggcuggucuugaac

SEQ ID NO: 36733 - RNA, 29 nt, Homo sapiens
gcagacgcacaaaacuuuaccauguuaga

SEQ ID NO: 36734 - RNA, 18 nt, Homo sapiens
accuuaauauugaaacua

SEQ ID NO: 36735 - RNA, 18 nt, Homo sapiens
ucuggugaaguuugugaa

SEQ ID NO: 36736 - RNA, 16 nt, Homo sapiens
ccaacaagaugagaca

SEQ ID NO: 36737 - RNA, 20 nt, Homo sapiens
uggguaaacuuauuaccuua

SEQ ID NO: 36738 - RNA, 18 nt, Homo sapiens
ccaccaccagucucugaa

SEQ ID NO: 36739 - RNA, 22 nt, Homo sapiens
cuggugauuaacaaagaccucg

SEQ ID NO: 36740 - RNA, 22 nt, Homo sapiens
caaacaggcagggagccacagu

SEQ ID NO: 36741 - RNA, 21 nt, Homo sapiens
gaaacugacacagggagcuca

SEQ ID NO: 36742 - RNA, 17 nt, Homo sapiens
uuccuucccugccuuuu

SEQ ID NO: 36743 - RNA, 19 nt, Homo sapiens
ugugccccuccuggacucg

SEQ ID NO: 36744 - RNA, 19 nt, Homo sapiens
caacguccaggguggcaga

SEQ ID NO: 36745 - RNA, 23 nt, Homo sapiens
cuuuggugaaccccacaugcgag

SEQ ID NO: 36746 - RNA, 18 nt, Homo sapiens
ggcuggccaugucuagca

SEQ ID NO: 36747 - RNA, 17 nt, Homo sapiens
guccaggguggcagaua

SEQ ID NO: 36748 - RNA, 17 nt, Homo sapiens
ugcgaggcggcuggcca

SEQ ID NO: 36749 - RNA, 20 nt, Homo sapiens
ccagcggcggcggacccuca

SEQ ID NO: 36750 - RNA, 22 nt, Homo sapiens
cccucccuuuaacccccuucca

SEQ ID NO: 36751 - RNA, 18 nt, Homo sapiens
gagccucaguuucccuca

SEQ ID NO: 36752 - RNA, 22 nt, Homo sapiens
gucugggcucuggcuggaacua

SEQ ID NO: 36753 - RNA, 20 nt, Homo sapiens
gccugacuuguguaaccacu

SEQ ID NO: 36754 - RNA, 19 nt, Homo sapiens
gucuucccuccaugcacac

SEQ ID NO: 36755 - RNA, 19 nt, Homo sapiens
aaggaccagcaacucaugg

SEQ ID NO: 36756 - RNA, 22 nt, Homo sapiens
aaugggagcaguccauggugca

SEQ ID NO: 36757 - RNA, 17 nt, Homo sapiens
caucgcccaguacacca

SEQ ID NO: 36758 - RNA, 19 nt, Homo sapiens
gauuacauaaaugccuggc

SEQ ID NO: 36759 - RNA, 20 nt, Homo sapiens
ggguagcaacaaguacauca

SEQ ID NO: 36760 - RNA, 17 nt, Homo sapiens
ucccgacaccugcucac

SEQ ID NO: 36761 - RNA, 19 nt, Homo sapiens
gcgauucccuccucuacuc

SEQ ID NO: 36762 - RNA, 21 nt, Homo sapiens
aggguuccugauggcuuuuua

SEQ ID NO: 36763 - RNA, 19 nt, Homo sapiens
caacaaaaaagaacaagag

SEQ ID NO: 36764 - RNA, 23 nt, Homo sapiens
gucuccuggggcagaguaugcca

SEQ ID NO: 36765 - RNA, 22 nt, Homo sapiens
acccagagaagcacagaccccg

SEQ ID NO: 36766 - RNA, 19 nt, Homo sapiens
ccagcccccacacccgucc

SEQ ID NO: 36767 - RNA, 19 nt, Homo sapiens
cccggccugcgcgccugca

SEQ ID NO: 36768 - RNA, 22 nt, Homo sapiens
ccuccaaccuccgcuuccacca

SEQ ID NO: 36769 - RNA, 21 nt, Homo sapiens
gcccccuggccugugcaagcc

SEQ ID NO: 36770 - RNA, 18 nt, Homo sapiens
accuaggaggagaugcca

SEQ ID NO: 36771 - RNA, 23 nt, Homo sapiens
caccaccaucaucaccaccacca

SEQ ID NO: 36772 - RNA, 23 nt, Homo sapiens
caucaucaccaccaccaucacca

SEQ ID NO: 36773 - RNA, 20 nt, Homo sapiens
cuccagggcccagcauggca

SEQ ID NO: 36774 - RNA, 25 nt, Homo sapiens
gacuugcaccacaguccagcagcaa

SEQ ID NO: 36775 - RNA, 22 nt, Homo sapiens
ggcguggaaaucaagguccaga

SEQ ID NO: 36776 - RNA, 20 nt, Homo sapiens
uccagcuuauggagauguga

SEQ ID NO: 36777 - RNA, 19 nt, Homo sapiens
ggcucggguguuguagcaa

SEQ ID NO: 36778 - RNA, 24 nt, Homo sapiens
ugagugggggcgagcacggggcug

SEQ ID NO: 36779 - RNA, 19 nt, Homo sapiens
accucccauccaugcacac

SEQ ID NO: 36780 - RNA, 21 nt, Homo sapiens
agcacgaucugcagcuuugaa

SEQ ID NO: 36781 - RNA, 18 nt, Homo sapiens
aggcugaggccccgggag

SEQ ID NO: 36782 - RNA, 21 nt, Homo sapiens
caccugugcccccaggcucaa

SEQ ID NO: 36783 - RNA, 20 nt, Homo sapiens
ccagccuccacccccacucc

SEQ ID NO: 36784 - RNA, 18 nt, Homo sapiens
ccccaagccaggacccca

SEQ ID NO: 36785 - RNA, 19 nt, Homo sapiens
ugcgggggugggguggggg

SEQ ID NO: 36786 - RNA, 19 nt, Homo sapiens
accccugagggccuggaga

SEQ ID NO: 36787 - RNA, 16 nt, Homo sapiens
gcgaccucacauucua

SEQ ID NO: 36788 - RNA, 18 nt, Homo sapiens
ccuaagcaauccucccac

SEQ ID NO: 36789 - RNA, 24 nt, Homo sapiens
cuugaguuuuuuuggguuuuuuuu

SEQ ID NO: 36790 - RNA, 24 nt, Homo sapiens
caugcggaagauggcggcguccaa

SEQ ID NO: 36791 - RNA, 18 nt, Homo sapiens
gcaguuaccuaccaguua

SEQ ID NO: 36792 - RNA, 19 nt, Homo sapiens
gggaagcggcggcggcggc

SEQ ID NO: 36793 - RNA, 20 nt, Homo sapiens
gggggcggcagggggcuagc

SEQ ID NO: 36794 - RNA, 20 nt, Homo sapiens
uuuaagaauuugccaucagu

SEQ ID NO: 36795 - RNA, 18 nt, Homo sapiens
aaaaacaaaacaaacaaa

SEQ ID NO: 36796 - RNA, 20 nt, Homo sapiens
accagggcggcacgcuggcc

SEQ ID NO: 36797 - RNA, 20 nt, Homo sapiens
aucugugacaaaauauuucg

SEQ ID NO: 36798 - RNA, 19 nt, Homo sapiens
ccuugagcaaaacugcaca

SEQ ID NO: 36799 - RNA, 20 nt, Homo sapiens
cgccaacuccuccaagccac

SEQ ID NO: 36800 - RNA, 17 nt, Homo sapiens
gggcggcacgcuggccg

SEQ ID NO: 36801 - RNA, 21 nt, Homo sapiens
caugagcuggggauuugggga

SEQ ID NO: 36802 - RNA, 23 nt, Homo sapiens
ugagagucccugggguccaguca

SEQ ID NO: 36803 - RNA, 23 nt, Homo sapiens
ggcaagaaagacuacaccuucca

SEQ ID NO: 36804 - RNA, 20 nt, Homo sapiens
cagugccuugccaggauccc

SEQ ID NO: 36805 - RNA, 21 nt, Homo sapiens
aucuacacagaagccauugug

SEQ ID NO: 36806 - RNA, 23 nt, Homo sapiens
caaccccaguuuuguccgcugca

SEQ ID NO: 36807 - RNA, 20 nt, Homo sapiens
caggaucgugaggaccaguc

SEQ ID NO: 36808 - RNA, 22 nt, Homo sapiens
cauccucuuccaggaguuccgg

SEQ ID NO: 36809 - RNA, 18 nt, Homo sapiens
cauucucugcacuggaga

SEQ ID NO: 36810 - RNA, 21 nt, Homo sapiens
gcauccucuuccaggaguucc

SEQ ID NO: 36811 - RNA, 18 nt, Homo sapiens
gcgccacgaggugccacc

SEQ ID NO: 36812 - RNA, 24 nt, Homo sapiens
gcgccucuuccgcuggcugguucu

SEQ ID NO: 36813 - RNA, 19 nt, Homo sapiens
ggagagcgggaggcggcug

SEQ ID NO: 36814 - RNA, 23 nt, Homo sapiens
ugaggcgucccggcgaggagcug

SEQ ID NO: 36815 - RNA, 22 nt, Homo sapiens
cuccccgcccuccucugucccu

SEQ ID NO: 36816 - RNA, 17 nt, Homo sapiens
aggcaggauaaucacuu

SEQ ID NO: 36817 - RNA, 16 nt, Homo sapiens
agccccucuucccaca

SEQ ID NO: 36818 - RNA, 17 nt, Homo sapiens
augggcuacuugucaua

SEQ ID NO: 36819 - RNA, 16 nt, Homo sapiens
ccucauucuugcugcu

SEQ ID NO: 36820 - RNA, 20 nt, Homo sapiens
cugcauggguucaaauccca

SEQ ID NO: 36821 - RNA, 20 nt, Homo sapiens
cugcauggguucaaauccca

SEQ ID NO: 36822 - RNA, 20 nt, Homo sapiens
cugcauggguucaaauccca

SEQ ID NO: 36823 - RNA, 20 nt, Homo sapiens
gcucucccuccagagccugu

SEQ ID NO: 36824 - RNA, 21 nt, Homo sapiens
ggacagggcucacacaccuca

SEQ ID NO: 36825 - RNA, 17 nt, Homo sapiens
ugacaagaacuacuuca

SEQ ID NO: 36826 - RNA, 17 nt, Homo sapiens
uuccugugcucucccuc

SEQ ID NO: 36827 - RNA, 18 nt, Homo sapiens
uucuuggguuccgcgugu

SEQ ID NO: 36828 - RNA, 18 nt, Homo sapiens
aagagacccgcuccucca

SEQ ID NO: 36829 - RNA, 20 nt, Homo sapiens
ccaacccugggaaaccaucc

SEQ ID NO: 36830 - RNA, 20 nt, Homo sapiens
gcuggaggggggucuuuguc

SEQ ID NO: 36831 - RNA, 18 nt, Homo sapiens
uccuccacuuucaggugu

SEQ ID NO: 36832 - RNA, 20 nt, Homo sapiens
ugccaagaccaucgccaagc

SEQ ID NO: 36833 - RNA, 21 nt, Homo sapiens
cccgucucuacuaaaaaucca

SEQ ID NO: 36834 - RNA, 21 nt, Homo sapiens
cccuccccucucuucuccucc

SEQ ID NO: 36835 - RNA, 21 nt, Homo sapiens
cccugauccucaaggaccugu

SEQ ID NO: 36836 - RNA, 22 nt, Homo sapiens
gaaccaagaucaugccacugca

SEQ ID NO: 36837 - RNA, 21 nt, Homo sapiens
gagaauuccuggguccaauca

SEQ ID NO: 36838 - RNA, 16 nt, Homo sapiens
gcacuuguaccucccu

SEQ ID NO: 36839 - RNA, 17 nt, Homo sapiens
acucaucuggagcccgg

SEQ ID NO: 36840 - RNA, 21 nt, Homo sapiens
cuccgagcaccggagcugcgg

SEQ ID NO: 36841 - RNA, 20 nt, Homo sapiens
gaggcgagaaccaagauccc

SEQ ID NO: 36842 - RNA, 17 nt, Homo sapiens
ggagacggcggugugcc

SEQ ID NO: 36843 - RNA, 20 nt, Homo sapiens
cccgcuuucugaaccucuca

SEQ ID NO: 36844 - RNA, 20 nt, Homo sapiens
ccuuuuugaccucuugaccu

SEQ ID NO: 36845 - RNA, 18 nt, Homo sapiens
uccuucccuccccgcuuu

SEQ ID NO: 36846 - RNA, 19 nt, Homo sapiens
ggccacuuccgaguggauc

SEQ ID NO: 36847 - RNA, 22 nt, Homo sapiens
uuucuucucuggcuguggccuu

SEQ ID NO: 36848 - RNA, 17 nt, Homo sapiens
agaggaccuauuccuuu

SEQ ID NO: 36849 - RNA, 23 nt, Homo sapiens
cccaguguugcauccccacuucc

SEQ ID NO: 36850 - RNA, 20 nt, Homo sapiens
ccugccgcuccccugccaca

SEQ ID NO: 36851 - RNA, 19 nt, Homo sapiens
cugcaaccuccgccuccca

SEQ ID NO: 36852 - RNA, 25 nt, Homo sapiens
gacaguaggaggcuaccuuuccuca

SEQ ID NO: 36853 - RNA, 17 nt, Homo sapiens
gcuuuaagaauuuuuug

SEQ ID NO: 36854 - RNA, 24 nt, Homo sapiens
gcuuuucccccaguuccccaagag

SEQ ID NO: 36855 - RNA, 26 nt, Homo sapiens
uaccuuuccucaucuccagcuucugc

SEQ ID NO: 36856 - RNA, 18 nt, Homo sapiens
uccgccucccagguucaa

SEQ ID NO: 36857 - RNA, 21 nt, Homo sapiens
ugacuaaaagccucccccagg

SEQ ID NO: 36858 - RNA, 22 nt, Homo sapiens
uggccccagagagcuccuucac

SEQ ID NO: 36859 - RNA, 19 nt, Homo sapiens
uugaggaugcagcaagaaa

SEQ ID NO: 36860 - RNA, 22 nt, Homo sapiens
ggccagaacccgucuacagagg

SEQ ID NO: 36861 - RNA, 18 nt, Homo sapiens
gcccuugcgauuucuuuu

SEQ ID NO: 36862 - RNA, 19 nt, Homo sapiens
gcuuuuccugagggcacug

SEQ ID NO: 36863 - RNA, 19 nt, Homo sapiens
accccaccgcccucccucu

SEQ ID NO: 36864 - RNA, 20 nt, Homo sapiens
caugcaccgaacugcgggga

SEQ ID NO: 36865 - RNA, 17 nt, Homo sapiens
ccccaccgcccucccuc

SEQ ID NO: 36866 - RNA, 23 nt, Homo sapiens
acuugggucccucugccuugccu

SEQ ID NO: 36867 - RNA, 17 nt, Homo sapiens
auucuccucuccucuga

SEQ ID NO: 36868 - RNA, 18 nt, Homo sapiens
ccucuccucugaccccuc

SEQ ID NO: 36869 - RNA, 24 nt, Homo sapiens
cgucgcgguacaacgugcuggcca

SEQ ID NO: 36870 - RNA, 20 nt, Homo sapiens
cugauaacuugauguucuuc

SEQ ID NO: 36871 - RNA, 18 nt, Homo sapiens
gacggcccuucucucucc

SEQ ID NO: 36872 - RNA, 20 nt, Homo sapiens
gccucccugaccgcuugcuu

SEQ ID NO: 36873 - RNA, 18 nt, Homo sapiens
gggugccccgucuccauc

SEQ ID NO: 36874 - RNA, 22 nt, Homo sapiens
ucuugggagugaggacuugggg

SEQ ID NO: 36875 - RNA, 21 nt, Homo sapiens
ucuugggguggggaucugagg

SEQ ID NO: 36876 - RNA, 21 nt, Homo sapiens
ugaauggcuugagugggacug

SEQ ID NO: 36877 - RNA, 22 nt, Homo sapiens
aacugguacccacacuugcccu

SEQ ID NO: 36878 - RNA, 18 nt, Homo sapiens
caagucucaguccccuca

SEQ ID NO: 36879 - RNA, 25 nt, Homo sapiens
cucuggugcuccuaacaccugugag

SEQ ID NO: 36880 - RNA, 18 nt, Homo sapiens
ugaagcccuugguaucgc

SEQ ID NO: 36881 - RNA, 19 nt, Homo sapiens
acguaauccccacauuuga

SEQ ID NO: 36882 - RNA, 19 nt, Homo sapiens
augggcagaaaaauuccuu

SEQ ID NO: 36883 - RNA, 22 nt, Homo sapiens
ccccagcaagcaaaaacauuua

SEQ ID NO: 36884 - RNA, 21 nt, Homo sapiens
gagggaugauaucaucucuca

SEQ ID NO: 36885 - RNA, 18 nt, Homo sapiens
uggaaccugguaugagau

SEQ ID NO: 36886 - RNA, 23 nt, Homo sapiens
caucguauccaaaaggcucuuuu

SEQ ID NO: 36887 - RNA, 20 nt, Homo sapiens
ugggaaucucuaaugugaaa

SEQ ID NO: 36888 - RNA, 21 nt, Homo sapiens
ccuccagccagagauauucca

SEQ ID NO: 36889 - RNA, 19 nt, Homo sapiens
ggagaccugacuggaacug

SEQ ID NO: 36890 - RNA, 22 nt, Homo sapiens
guccagcuucuuggccaccuuu

SEQ ID NO: 36891 - RNA, 17 nt, Homo sapiens
uuaaaacugcaguuccu

SEQ ID NO: 36892 - RNA, 22 nt, Homo sapiens
uugcccaagaccacugcuaccu

SEQ ID NO: 36893 - RNA, 17 nt, Homo sapiens
aacuccaggacaaggca

SEQ ID NO: 36894 - RNA, 19 nt, Homo sapiens
ggaggaggcuaaggcugcc

SEQ ID NO: 36895 - RNA, 16 nt, Homo sapiens
ggagagaaaggcacuu

SEQ ID NO: 36896 - RNA, 21 nt, Homo sapiens
agccaagauuguaccacugca

SEQ ID NO: 36897 - RNA, 18 nt, Homo sapiens
cagggcugcuuuuccuga

SEQ ID NO: 36898 - RNA, 17 nt, Homo sapiens
cugcuaguaacuauugg

SEQ ID NO: 36899 - RNA, 18 nt, Homo sapiens
gaauacgcuggcgcucuc

SEQ ID NO: 36900 - RNA, 21 nt, Homo sapiens
gcuuuggagauuuggaaagca

SEQ ID NO: 36901 - RNA, 19 nt, Homo sapiens
ugggaggaagcgucuguuu

SEQ ID NO: 36902 - RNA, 21 nt, Homo sapiens
uccuggaggaaguacacaagc

SEQ ID NO: 36903 - RNA, 20 nt, Homo sapiens
caccuucacccaccauguga

SEQ ID NO: 36904 - RNA, 19 nt, Homo sapiens
cuguggaugcccucaccuu

SEQ ID NO: 36905 - RNA, 15 nt, Homo sapiens
gccuuucuugcugcu

SEQ ID NO: 36906 - RNA, 20 nt, Homo sapiens
cugcacuguggguguccacc

SEQ ID NO: 36907 - RNA, 19 nt, Homo sapiens
cuucccugucucugccucu

SEQ ID NO: 36908 - RNA, 19 nt, Homo sapiens
gcaagauccugguggguga

SEQ ID NO: 36909 - RNA, 20 nt, Homo sapiens
gccuggaccgcggagacgcc

SEQ ID NO: 36910 - RNA, 28 nt, Homo sapiens
uaggugggccaaguccuggcaggagcug

SEQ ID NO: 36911 - RNA, 22 nt, Homo sapiens
acccggaaagccccccaggcug

SEQ ID NO: 36912 - RNA, 16 nt, Homo sapiens
gcggggguggagcggg

SEQ ID NO: 36913 - RNA, 20 nt, Homo sapiens
ugacgauuucaaccucacac

SEQ ID NO: 36914 - RNA, 19 nt, Homo sapiens
uguuauuuacuacauugug

SEQ ID NO: 36915 - RNA, 18 nt, Homo sapiens
caccauucuccugccuca

SEQ ID NO: 36916 - RNA, 22 nt, Homo sapiens
ccuuauuccuucucugccucca

SEQ ID NO: 36917 - RNA, 17 nt, Homo sapiens
cugcuugcuaucccuuu

SEQ ID NO: 36918 - RNA, 19 nt, Homo sapiens
cuuauuccuucucugccuc

SEQ ID NO: 36919 - RNA, 25 nt, Homo sapiens
uagauggggguuaugguugaaacug

SEQ ID NO: 36920 - RNA, 21 nt, Homo sapiens
cguguccaagaaguuccacca

SEQ ID NO: 36921 - RNA, 18 nt, Homo sapiens
acacucaggccugagaga

SEQ ID NO: 36922 - RNA, 17 nt, Homo sapiens
caccucccuccuuuuuc

SEQ ID NO: 36923 - RNA, 19 nt, Homo sapiens
ggggauagaacaucuuuca

SEQ ID NO: 36924 - RNA, 17 nt, Homo sapiens
aaaaggugcagguauga

SEQ ID NO: 36925 - RNA, 20 nt, Homo sapiens
aaaguagucuugaacaggua

SEQ ID NO: 36926 - RNA, 16 nt, Homo sapiens
augccuauacuuuuuu

SEQ ID NO: 36927 - RNA, 22 nt, Homo sapiens
guguucucauuuuuucugggua

SEQ ID NO: 36928 - RNA, 21 nt, Homo sapiens
aucuuggcucacugcaaccuc

SEQ ID NO: 36929 - RNA, 22 nt, Homo sapiens
ccaaaccauaccugggccuguu

SEQ ID NO: 36930 - RNA, 18 nt, Homo sapiens
cuuagcccccuugccucu

SEQ ID NO: 36931 - RNA, 23 nt, Homo sapiens
ggcguugguaagaugugacccuc

SEQ ID NO: 36932 - RNA, 25 nt, Homo sapiens
guaccuguuggacaagauuaugaua

SEQ ID NO: 36933 - RNA, 21 nt, Homo sapiens
uggagcaauaagauuacuuuu

SEQ ID NO: 36934 - RNA, 17 nt, Homo sapiens
ccaaaccccgccaccau

SEQ ID NO: 36935 - RNA, 20 nt, Homo sapiens
gccucuguccuuguaaguca

SEQ ID NO: 36936 - RNA, 27 nt, Homo sapiens
gugggguccagcgcuggcugggcccag

SEQ ID NO: 36937 - RNA, 20 nt, Homo sapiens
aaacucugaggcuuugguga

SEQ ID NO: 36938 - RNA, 19 nt, Homo sapiens
aagcaauucuccugcccca

SEQ ID NO: 36939 - RNA, 17 nt, Homo sapiens
acauguacgugcacagg

SEQ ID NO: 36940 - RNA, 18 nt, Homo sapiens
ccagcuggagaccaugcc

SEQ ID NO: 36941 - RNA, 21 nt, Homo sapiens
ccaucuguguccccaugccca

SEQ ID NO: 36942 - RNA, 19 nt, Homo sapiens
ccugauaauaaaacucuga

SEQ ID NO: 36943 - RNA, 19 nt, Homo sapiens
cugcaaccuccgccuccca

SEQ ID NO: 36944 - RNA, 24 nt, Homo sapiens
ggcacacacauacacuccugcgug

SEQ ID NO: 36945 - RNA, 20 nt, Homo sapiens
guaccugaaugugagcuccu

SEQ ID NO: 36946 - RNA, 23 nt, Homo sapiens
uccugcgugugcacaagcacaca

SEQ ID NO: 36947 - RNA, 20 nt, Homo sapiens
uggucaggcuggucuugaac

SEQ ID NO: 36948 - RNA, 19 nt, Homo sapiens
caagagcaggagcaucuaa

SEQ ID NO: 36949 - RNA, 19 nt, Homo sapiens
ccuccgcgcgcgccgcagc

SEQ ID NO: 36950 - RNA, 19 nt, Homo sapiens
aauugcccccauuugagaa

SEQ ID NO: 36951 - RNA, 21 nt, Homo sapiens
gcccccaaaaaugucucuaga

SEQ ID NO: 36952 - RNA, 23 nt, Homo sapiens
uggcagcacauugagaucggcua

SEQ ID NO: 36953 - RNA, 22 nt, Homo sapiens
uggcugaagauugacuuagaga

SEQ ID NO: 36954 - RNA, 16 nt, Homo sapiens
uuggcgauguucugga

SEQ ID NO: 36955 - RNA, 20 nt, Homo sapiens
caaguccugcgaugcuaagu

SEQ ID NO: 36956 - RNA, 23 nt, Homo sapiens
cauaacacaggagaccugcuccc

SEQ ID NO: 36957 - RNA, 22 nt, Homo sapiens
ccagggcguccuccagcucagc

SEQ ID NO: 36958 - RNA, 19 nt, Homo sapiens
gaauguucucaguguccua

SEQ ID NO: 36959 - RNA, 20 nt, Homo sapiens
gagaaauauggauggggagc

SEQ ID NO: 36960 - RNA, 19 nt, Homo sapiens
ggagcacucugagaucuca

SEQ ID NO: 36961 - RNA, 21 nt, Homo sapiens
uaaaaugcuggaaaacuguaa

SEQ ID NO: 36962 - RNA, 20 nt, Homo sapiens
ugcgauggcguucacgucca

SEQ ID NO: 36963 - RNA, 22 nt, Homo sapiens
auggcacagugcauuugcugua

SEQ ID NO: 36964 - RNA, 22 nt, Homo sapiens
cccagauaaguuugguuuucaa

SEQ ID NO: 36965 - RNA, 23 nt, Homo sapiens
gcccugggagcagauggcccuga

SEQ ID NO: 36966 - RNA, 18 nt, Homo sapiens
uccuuuaauuuaccugau

SEQ ID NO: 36967 - RNA, 16 nt, Homo sapiens
ugcaaaauacaagcuc

SEQ ID NO: 36968 - RNA, 22 nt, Homo sapiens
cucucucucucuucuuucucuc

SEQ ID NO: 36969 - RNA, 24 nt, Homo sapiens
caccaccaccacccuggcuccccu

SEQ ID NO: 36970 - RNA, 25 nt, Homo sapiens
cgcccccacuuccccaucuaccucu

SEQ ID NO: 36971 - RNA, 18 nt, Homo sapiens
ccaaaauaggaugagaug

SEQ ID NO: 36972 - RNA, 20 nt, Homo sapiens
auucuagagccaaguguucc

SEQ ID NO: 36973 - RNA, 17 nt, Homo sapiens
cauugaacuggaugcau

SEQ ID NO: 36974 - RNA, 19 nt, Homo sapiens
ggacacuccugcagagcca

SEQ ID NO: 36975 - RNA, 18 nt, Homo sapiens
uagagcugugugacuuua

SEQ ID NO: 36976 - RNA, 18 nt, Homo sapiens
ucccucagucccaaauuc

SEQ ID NO: 36977 - RNA, 24 nt, Homo sapiens
uggcauaguaaacauuuucuugga

SEQ ID NO: 36978 - RNA, 17 nt, Homo sapiens
gagcuuugaguguacau

SEQ ID NO: 36979 - RNA, 18 nt, Homo sapiens
guugaacauauguauacc

SEQ ID NO: 36980 - RNA, 17 nt, Homo sapiens
uacuggugacaguguga

SEQ ID NO: 36981 - RNA, 20 nt, Homo sapiens
ucuucuacccuagaucugau

SEQ ID NO: 36982 - RNA, 17 nt, Homo sapiens
ugaacaagcacuucaca

SEQ ID NO: 36983 - RNA, 21 nt, Homo sapiens
cugccugauucuccugccuca

SEQ ID NO: 36984 - RNA, 17 nt, Homo sapiens
auacuauugcuuccuuu

SEQ ID NO: 36985 - RNA, 20 nt, Homo sapiens
uggcaaagcuuaggcuucua

SEQ ID NO: 36986 - RNA, 18 nt, Homo sapiens
cagcagggcauguuacca

SEQ ID NO: 36987 - RNA, 23 nt, Homo sapiens
gugugugccaccauacuuggcua

SEQ ID NO: 36988 - RNA, 22 nt, Homo sapiens
gccgcccccuggggauccagcg

SEQ ID NO: 36989 - RNA, 20 nt, Homo sapiens
uccucccuuggggucuagag

SEQ ID NO: 36990 - RNA, 19 nt, Homo sapiens
gguccuugcgggcaccaca

SEQ ID NO: 36991 - RNA, 19 nt, Homo sapiens
aaggacccuaggcccagcg

SEQ ID NO: 36992 - RNA, 21 nt, Homo sapiens
ccccggagccugcaaaagugu

SEQ ID NO: 36993 - RNA, 18 nt, Homo sapiens
gccccugcccccaccccc

SEQ ID NO: 36994 - RNA, 18 nt, Homo sapiens
aaaauguacuggugugau

SEQ ID NO: 36995 - RNA, 21 nt, Homo sapiens
aaagcaugugacauauugcua

SEQ ID NO: 36996 - RNA, 21 nt, Homo sapiens
aagugaaaauauuagccuuaa

SEQ ID NO: 36997 - RNA, 21 nt, Homo sapiens
augucuggugucugucaugcc

SEQ ID NO: 36998 - RNA, 17 nt, Homo sapiens
cucuuucacucagaagc

SEQ ID NO: 36999 - RNA, 19 nt, Homo sapiens
gcucccaagaggcuccuga

SEQ ID NO: 37000 - RNA, 20 nt, Homo sapiens
ggagagggcuggccugguca

SEQ ID NO: 37001 - RNA, 21 nt, Homo sapiens
auucuacugcagguguuucca

SEQ ID NO: 37002 - RNA, 19 nt, Homo sapiens
guaugacccaucauuugau

SEQ ID NO: 37003 - RNA, 16 nt, Homo sapiens
uacugcagguguuucc

SEQ ID NO: 37004 - RNA, 21 nt, Homo sapiens
uggaaucgaaaucauaagaua

SEQ ID NO: 37005 - RNA, 21 nt, Homo sapiens
aaauugaacugagaccaguga

SEQ ID NO: 37006 - RNA, 19 nt, Homo sapiens
gcuuuguauaaaggucugu

SEQ ID NO: 37007 - RNA, 24 nt, Homo sapiens
caaggauaccaaggcaagcauaca

SEQ ID NO: 37008 - RNA, 21 nt, Homo sapiens
uuuaggaaauaaauccucucc

SEQ ID NO: 37009 - RNA, 22 nt, Homo sapiens
cggaugagaugacagcucgcca

SEQ ID NO: 37010 - RNA, 18 nt, Homo sapiens
cucacccaagcugcaguu

SEQ ID NO: 37011 - RNA, 22 nt, Homo sapiens
ggaacugugauggaccacuucc

SEQ ID NO: 37012 - RNA, 20 nt, Homo sapiens
aauacaguguauuuuguuau

SEQ ID NO: 37013 - RNA, 20 nt, Homo sapiens
caaagaaagaaggaagaaca

SEQ ID NO: 37014 - RNA, 15 nt, Homo sapiens
agaggcaaaacuguc

SEQ ID NO: 37015 - RNA, 15 nt, Homo sapiens
ccugugcuuucugaa

SEQ ID NO: 37016 - RNA, 18 nt, Homo sapiens
cggugucucuccucuaga

SEQ ID NO: 37017 - RNA, 25 nt, Homo sapiens
gagaaguuggccuucaaggggcuca

SEQ ID NO: 37018 - RNA, 18 nt, Homo sapiens
gcaaaacuguccauugaa

SEQ ID NO: 37019 - RNA, 22 nt, Homo sapiens
cuuccguaugcuguuugacuuu

SEQ ID NO: 37020 - RNA, 18 nt, Homo sapiens
cuuucuaccucugcuccu

SEQ ID NO: 37021 - RNA, 20 nt, Homo sapiens
cacaucuacacuauuuccuu

SEQ ID NO: 37022 - RNA, 20 nt, Homo sapiens
gucuggaacgccugaccuca

SEQ ID NO: 37023 - RNA, 17 nt, Homo sapiens
aggaagccggggagaca

SEQ ID NO: 37024 - RNA, 21 nt, Homo sapiens
cgaggccugcugggcuuggca

SEQ ID NO: 37025 - RNA, 23 nt, Homo sapiens
aucuguggcaaauuguauaugau

SEQ ID NO: 37026 - RNA, 21 nt, Homo sapiens
ccauccauaggaaaauggaua

SEQ ID NO: 37027 - RNA, 19 nt, Homo sapiens
uagcuugugagcuuucuca

SEQ ID NO: 37028 - RNA, 19 nt, Homo sapiens
guauaaaaccaaaugcuua

SEQ ID NO: 37029 - RNA, 18 nt, Homo sapiens
caaggauaaccugggcca

SEQ ID NO: 37030 - RNA, 18 nt, Homo sapiens
cuaccaggacaccuggca

SEQ ID NO: 37031 - RNA, 22 nt, Homo sapiens
cuggcucagcuaauccuuguca

SEQ ID NO: 37032 - RNA, 18 nt, Homo sapiens
ggaccucagugugaagcu

SEQ ID NO: 37033 - RNA, 18 nt, Homo sapiens
ucagugugaagcuuauuc

SEQ ID NO: 37034 - RNA, 21 nt, Homo sapiens
ccucccccacagccccuuucc

SEQ ID NO: 37035 - RNA, 22 nt, Homo sapiens
cgcggcucugcacccgcgccgc

SEQ ID NO: 37036 - RNA, 23 nt, Homo sapiens
uccuggccccagaagccugcgga

SEQ ID NO: 37037 - RNA, 17 nt, Homo sapiens
aaguugacuuuuggcuu

SEQ ID NO: 37038 - RNA, 21 nt, Homo sapiens
agcuuaugcaacaugcucagc

SEQ ID NO: 37039 - RNA, 18 nt, Homo sapiens
aggcggacccucuggcgc

SEQ ID NO: 37040 - RNA, 17 nt, Homo sapiens
auuuuuugccaaagugu

SEQ ID NO: 37041 - RNA, 19 nt, Homo sapiens
cacugcuuuccccaccagg

SEQ ID NO: 37042 - RNA, 16 nt, Homo sapiens
ucagucuccuuuucua

SEQ ID NO: 37043 - RNA, 18 nt, Homo sapiens
uguuugacuaaauacaau

SEQ ID NO: 37044 - RNA, 19 nt, Homo sapiens
ccagagccugucugcuaua

SEQ ID NO: 37045 - RNA, 21 nt, Homo sapiens
cucgggcagagcuuugugaga

SEQ ID NO: 37046 - RNA, 24 nt, Homo sapiens
gccucaauacgaucauagaagcca

SEQ ID NO: 37047 - RNA, 20 nt, Homo sapiens
ugaacuucacauuucccaca

SEQ ID NO: 37048 - RNA, 23 nt, Homo sapiens
ugggugggcaacuuggggagcug

SEQ ID NO: 37049 - RNA, 24 nt, Homo sapiens
gccugagcucacuuguuguggccu

SEQ ID NO: 37050 - RNA, 23 nt, Homo sapiens
ucagcacuuugggcaagugguug

SEQ ID NO: 37051 - RNA, 16 nt, Homo sapiens
ucugauagcugguguu

SEQ ID NO: 37052 - RNA, 21 nt, Homo sapiens
ccuaugugaauaaaauuacuc

SEQ ID NO: 37053 - RNA, 24 nt, Homo sapiens
guaguuuuggaauugccuuccuua

SEQ ID NO: 37054 - RNA, 18 nt, Homo sapiens
uccaucucccagguucaa

SEQ ID NO: 37055 - RNA, 23 nt, Homo sapiens
ucuauuaggaguuugguaaaaua

SEQ ID NO: 37056 - RNA, 17 nt, Homo sapiens
ucuucaccuguguuagg

SEQ ID NO: 37057 - RNA, 18 nt, Homo sapiens
ugauguuaugacuauuga

SEQ ID NO: 37058 - RNA, 23 nt, Homo sapiens
uuauagaugaaugcuuucauuug

SEQ ID NO: 37059 - RNA, 26 nt, Homo sapiens
auauaagaaauauuggaaagaugcuc

SEQ ID NO: 37060 - RNA, 21 nt, Homo sapiens
gucugagcaguuuugauuaga

SEQ ID NO: 37061 - RNA, 18 nt, Homo sapiens
ucugcuagucacuuuuuu

SEQ ID NO: 37062 - RNA, 19 nt, Homo sapiens
uuucauuucacugcugcug

SEQ ID NO: 37063 - RNA, 22 nt, Homo sapiens
cgggcgggacggaccgcggcca

SEQ ID NO: 37064 - RNA, 21 nt, Homo sapiens
ggcuagacgcuggcgcugagc

SEQ ID NO: 37065 - RNA, 19 nt, Homo sapiens
ugauuuucagcuggaauua

SEQ ID NO: 37066 - RNA, 18 nt, Homo sapiens
aguuuuuuuguuguuuuu

SEQ ID NO: 37067 - RNA, 20 nt, Homo sapiens
ccuuucugcuucugaaguau

SEQ ID NO: 37068 - RNA, 21 nt, Homo sapiens
gcaaggagcaucgaaauuuga

SEQ ID NO: 37069 - RNA, 20 nt, Homo sapiens
gcccaagcaauccugccuca

SEQ ID NO: 37070 - RNA, 21 nt, Homo sapiens
gccuaugugguuuuuuuucag

SEQ ID NO: 37071 - RNA, 19 nt, Homo sapiens
ucaccacugcgcccgcaaa

SEQ ID NO: 37072 - RNA, 20 nt, Homo sapiens
ugacuggcuaguuuuguuuu

SEQ ID NO: 37073 - RNA, 20 nt, Homo sapiens
ugggcauuugaacaguguga

SEQ ID NO: 37074 - RNA, 23 nt, Homo sapiens
cugagguagcuggagaccacagc

SEQ ID NO: 37075 - RNA, 20 nt, Homo sapiens
gauggcuucuuucugucaca

SEQ ID NO: 37076 - RNA, 16 nt, Homo sapiens
agguucaaguguaaca

SEQ ID NO: 37077 - RNA, 23 nt, Homo sapiens
ggaccgugcgcggcggccgcggc

SEQ ID NO: 37078 - RNA, 17 nt, Homo sapiens
gucucucaucauuugcu

SEQ ID NO: 37079 - RNA, 24 nt, Homo sapiens
uuagaaauuagcaaguagugcaua

SEQ ID NO: 37080 - RNA, 17 nt, Homo sapiens
uuccagaagcugauucc

SEQ ID NO: 37081 - RNA, 22 nt, Homo sapiens
accaauauuauugauuaccaga

SEQ ID NO: 37082 - RNA, 21 nt, Homo sapiens
agcauaauuuucauuaccaaa

SEQ ID NO: 37083 - RNA, 18 nt, Homo sapiens
aguauuugccuccugugu

SEQ ID NO: 37084 - RNA, 23 nt, Homo sapiens
cuggaaaaagaagccccagccca

SEQ ID NO: 37085 - RNA, 22 nt, Homo sapiens
cuuccuuucugccaucaucuca

SEQ ID NO: 37086 - RNA, 22 nt, Homo sapiens
gagccaagaucgugccacugca

SEQ ID NO: 37087 - RNA, 24 nt, Homo sapiens
guccaugauacuauaauugugaga

SEQ ID NO: 37088 - RNA, 20 nt, Homo sapiens
uacguuucacucaaguucuc

SEQ ID NO: 37089 - RNA, 20 nt, Homo sapiens
ucagaaaugugugacccuuc

SEQ ID NO: 37090 - RNA, 19 nt, Homo sapiens
aagcaauucuccugccuca

SEQ ID NO: 37091 - RNA, 21 nt, Homo sapiens
cuuuaugucguguaguuugua

SEQ ID NO: 37092 - RNA, 19 nt, Homo sapiens
ccaaguuuuauugaggcau

SEQ ID NO: 37093 - RNA, 18 nt, Homo sapiens
cccacaaccuccgccucc

SEQ ID NO: 37094 - RNA, 19 nt, Homo sapiens
gccauaauaaaaauuacau

SEQ ID NO: 37095 - RNA, 18 nt, Homo sapiens
uccgccucccagguucaa

SEQ ID NO: 37096 - RNA, 19 nt, Homo sapiens
uggauggauucacaagaaa

SEQ ID NO: 37097 - RNA, 20 nt, Homo sapiens
uggucaggcuggucuugaac

SEQ ID NO: 37098 - RNA, 18 nt, Homo sapiens
acacuuggcuaacaaaca

SEQ ID NO: 37099 - RNA, 19 nt, Homo sapiens
cucugguacccucugcccu

SEQ ID NO: 37100 - RNA, 20 nt, Homo sapiens
gcuggccuggugauguccca

SEQ ID NO: 37101 - RNA, 23 nt, Homo sapiens
agggagagcaaagacaaaauaca

SEQ ID NO: 37102 - RNA, 20 nt, Homo sapiens
aguucagguuggguuugguu

SEQ ID NO: 37103 - RNA, 17 nt, Homo sapiens
cagaggacucuagguuu

SEQ ID NO: 37104 - RNA, 18 nt, Homo sapiens
aacuccaucucaaucaau

SEQ ID NO: 37105 - RNA, 27 nt, Homo sapiens
agaaguaccgacacucccuauccuuca

SEQ ID NO: 37106 - RNA, 18 nt, Homo sapiens
agagccuuccagggccuc

SEQ ID NO: 37107 - RNA, 19 nt, Homo sapiens
ggggagcgcaggcaggaca

SEQ ID NO: 37108 - RNA, 22 nt, Homo sapiens
gccugggcuccagcuuuggcuc

SEQ ID NO: 37109 - RNA, 21 nt, Homo sapiens
acccugaacuccccaugugau

SEQ ID NO: 37110 - RNA, 19 nt, Homo sapiens
cacaucacguucaguguuu

SEQ ID NO: 37111 - RNA, 19 nt, Homo sapiens
cucacugcucacuugcaca

SEQ ID NO: 37112 - RNA, 18 nt, Homo sapiens
guguguucguacuccagg

SEQ ID NO: 37113 - RNA, 25 nt, Homo sapiens
uguggggauuaaagugcugcgggug

SEQ ID NO: 37114 - RNA, 19 nt, Homo sapiens
gaaaagcccuggcucccgc

SEQ ID NO: 37115 - RNA, 24 nt, Homo sapiens
augucauuucaccuccuguuccua

SEQ ID NO: 37116 - RNA, 17 nt, Homo sapiens
ucgagaaacugaucgcc

SEQ ID NO: 37117 - RNA, 22 nt, Homo sapiens
ucuaagaaaacuaugcguaaaa

SEQ ID NO: 37118 - RNA, 24 nt, Homo sapiens
uguaaccucaaacuccuggacuca

SEQ ID NO: 37119 - RNA, 19 nt, Homo sapiens
uuguacuacacaaguaaaa

SEQ ID NO: 37120 - RNA, 19 nt, Homo sapiens
cgaggcugcgccgcgugga

SEQ ID NO: 37121 - RNA, 18 nt, Homo sapiens
ucagcaggaggcggggau

SEQ ID NO: 37122 - RNA, 21 nt, Homo sapiens
caggcugccgugcaccauccu

SEQ ID NO: 37123 - RNA, 25 nt, Homo sapiens
ggccaggcugccgugcaccauccug

SEQ ID NO: 37124 - RNA, 22 nt, Homo sapiens
ucucugagcugccagcagccaa

SEQ ID NO: 37125 - RNA, 17 nt, Homo sapiens
cguccuccaggcaccuc

SEQ ID NO: 37126 - RNA, 22 nt, Homo sapiens
cuccaggcaccucgcccacggc

SEQ ID NO: 37127 - RNA, 18 nt, Homo sapiens
ggugccgcuccucacuca

SEQ ID NO: 37128 - RNA, 18 nt, Homo sapiens
ucaucuuccuggacguca

SEQ ID NO: 37129 - RNA, 17 nt, Homo sapiens
acaggacacccuggcua

SEQ ID NO: 37130 - RNA, 21 nt, Homo sapiens
ccugugcccuacaucccugag

SEQ ID NO: 37131 - RNA, 24 nt, Homo sapiens
gcagguuuccaaugaagccccacc

SEQ ID NO: 37132 - RNA, 18 nt, Homo sapiens
ucccaggugcaacugcag

SEQ ID NO: 37133 - RNA, 21 nt, Homo sapiens
gcauaacaaggccucccaacc

SEQ ID NO: 37134 - RNA, 21 nt, Homo sapiens
cagaccucauuaacucauuaa

SEQ ID NO: 37135 - RNA, 20 nt, Homo sapiens
ccucugccucccagguucaa

SEQ ID NO: 37136 - RNA, 19 nt, Homo sapiens
cugcaaccucugccuccca

SEQ ID NO: 37137 - RNA, 16 nt, Homo sapiens
gagggcaagauccaag

SEQ ID NO: 37138 - RNA, 21 nt, Homo sapiens
accaagccuuauucccacucc

SEQ ID NO: 37139 - RNA, 19 nt, Homo sapiens
uaauguauaaauguucccu

SEQ ID NO: 37140 - RNA, 22 nt, Homo sapiens
uuuuggaaauaaucauaacuug

SEQ ID NO: 37141 - RNA, 18 nt, Homo sapiens
agggagcccgagccaggc

SEQ ID NO: 37142 - RNA, 20 nt, Homo sapiens
ggcuuauaaucauguguuuu

SEQ ID NO: 37143 - RNA, 17 nt, Homo sapiens
ggggggugggcaaggug

SEQ ID NO: 37144 - RNA, 24 nt, Homo sapiens
cagaagaauagcuugagcccagga

SEQ ID NO: 37145 - RNA, 21 nt, Homo sapiens
gaaccuaaauuugaccaugcc

SEQ ID NO: 37146 - RNA, 17 nt, Homo sapiens
gaauggaauugugaagc

SEQ ID NO: 37147 - RNA, 15 nt, Homo sapiens
gcuucaaggcagcug

SEQ ID NO: 37148 - RNA, 24 nt, Homo sapiens
ugaauggauggaugaauggaauug

SEQ ID NO: 37149 - RNA, 20 nt, Homo sapiens
uggauggaugaauggaauug

SEQ ID NO: 37150 - RNA, 22 nt, Homo sapiens
uugaaccuaaauuugaccaugc

SEQ ID NO: 37151 - RNA, 19 nt, Homo sapiens
acuacuacugcacagcuga

SEQ ID NO: 37152 - RNA, 16 nt, Homo sapiens
ugaaggacauucagag

SEQ ID NO: 37153 - RNA, 19 nt, Homo sapiens
aacugcuagaaaaugggag

SEQ ID NO: 37154 - RNA, 19 nt, Homo sapiens
aauaucauuaggcauuggc

SEQ ID NO: 37155 - RNA, 22 nt, Homo sapiens
agaagagagaguaaaggaccuu

SEQ ID NO: 37156 - RNA, 21 nt, Homo sapiens
agggcaucaucagcgcacaac

SEQ ID NO: 37157 - RNA, 20 nt, Homo sapiens
caucugacuccuggguucaa

SEQ ID NO: 37158 - RNA, 22 nt, Homo sapiens
guguguauugguucauuuacua

SEQ ID NO: 37159 - RNA, 18 nt, Homo sapiens
ucagcaggauugcacuga

SEQ ID NO: 37160 - RNA, 24 nt, Homo sapiens
uugagguugugacacaagcugaca

SEQ ID NO: 37161 - RNA, 22 nt, Homo sapiens
uugucuccuauuuuuccauaac

SEQ ID NO: 37162 - RNA, 22 nt, Homo sapiens
aaguaauaccaaagggcuccug

SEQ ID NO: 37163 - RNA, 20 nt, Homo sapiens
caaggaagcagcuacuggac

SEQ ID NO: 37164 - RNA, 23 nt, Homo sapiens
cagaaccacaccuccacccuaac

SEQ ID NO: 37165 - RNA, 19 nt, Homo sapiens
ccaggcucacccaucaccc

SEQ ID NO: 37166 - RNA, 19 nt, Homo sapiens
cccagcuuccuccccuuuu

SEQ ID NO: 37167 - RNA, 21 nt, Homo sapiens
ccccacuggcaccaaauccca

SEQ ID NO: 37168 - RNA, 21 nt, Homo sapiens
ccuugaagaugccccacccca

SEQ ID NO: 37169 - RNA, 23 nt, Homo sapiens
cucugacggugggagggucacgg

SEQ ID NO: 37170 - RNA, 21 nt, Homo sapiens
cuuccacgugcagcacccagg

SEQ ID NO: 37171 - RNA, 23 nt, Homo sapiens
gagcacuggaaccucagauccag

SEQ ID NO: 37172 - RNA, 19 nt, Homo sapiens
gcuacuggggauuuuguau

SEQ ID NO: 37173 - RNA, 20 nt, Homo sapiens
uagguggaccucagagagga

SEQ ID NO: 37174 - RNA, 21 nt, Homo sapiens
aguuuacaucgagcaaaguga

SEQ ID NO: 37175 - RNA, 23 nt, Homo sapiens
ggggaccugguggcagcggcggc

SEQ ID NO: 37176 - RNA, 20 nt, Homo sapiens
uaucacuagaguucaccucu

SEQ ID NO: 37177 - RNA, 17 nt, Homo sapiens
ugauggacugagugaag

SEQ ID NO: 37178 - RNA, 16 nt, Homo sapiens
uucagaugagaaucca

SEQ ID NO: 37179 - RNA, 19 nt, Homo sapiens
caacccuccuccccugccc

SEQ ID NO: 37180 - RNA, 15 nt, Homo sapiens
cacagcccuuggcug

SEQ ID NO: 37181 - RNA, 19 nt, Homo sapiens
ccaggcgguccauguugaa

SEQ ID NO: 37182 - RNA, 21 nt, Homo sapiens
gaaagggcaaccucccuuuca

SEQ ID NO: 37183 - RNA, 19 nt, Homo sapiens
gacggcucccacuuccuuu

SEQ ID NO: 37184 - RNA, 20 nt, Homo sapiens
ucugcugggcccugaaggag

SEQ ID NO: 37185 - RNA, 21 nt, Homo sapiens
aauaagcgaagcccugaagca

SEQ ID NO: 37186 - RNA, 18 nt, Homo sapiens
caggaagacaaugguguu

SEQ ID NO: 37187 - RNA, 16 nt, Homo sapiens
ccucgccagcaccccg

SEQ ID NO: 37188 - RNA, 26 nt, Homo sapiens
cuucaccaaggagacccuggcaucac

SEQ ID NO: 37189 - RNA, 23 nt, Homo sapiens
ucucugcaggaagacaauggugu

SEQ ID NO: 37190 - RNA, 23 nt, Homo sapiens
caggggagaacuagauccuuuca

SEQ ID NO: 37191 - RNA, 16 nt, Homo sapiens
acaagucccugccuca

SEQ ID NO: 37192 - RNA, 22 nt, Homo sapiens
accaccucgcugcuguuccacu

SEQ ID NO: 37193 - RNA, 15 nt, Homo sapiens
aucaugggcuuugga

SEQ ID NO: 37194 - RNA, 18 nt, Homo sapiens
caacccuguggcugcccu

SEQ ID NO: 37195 - RNA, 22 nt, Homo sapiens
ucuuguugauuugcugccucca

SEQ ID NO: 37196 - RNA, 20 nt, Homo sapiens
ugugucuuagguuggcauuc

SEQ ID NO: 37197 - RNA, 19 nt, Homo sapiens
agcaaacccagaauacucc

SEQ ID NO: 37198 - RNA, 22 nt, Homo sapiens
cagccgcuagucagaaccacca

SEQ ID NO: 37199 - RNA, 23 nt, Homo sapiens
acuuugggaaauucaucugguca

SEQ ID NO: 37200 - RNA, 17 nt, Homo sapiens
caacauaucaacucaca

SEQ ID NO: 37201 - RNA, 19 nt, Homo sapiens
gcagaauuccugccaaagc

SEQ ID NO: 37202 - RNA, 18 nt, Homo sapiens
ggggacagcugcuguggc

SEQ ID NO: 37203 - RNA, 22 nt, Homo sapiens
gguucuacuuaaccucacugua

SEQ ID NO: 37204 - RNA, 18 nt, Homo sapiens
uaauuccagacucugauc

SEQ ID NO: 37205 - RNA, 16 nt, Homo sapiens
ugucaagaagcauuga

SEQ ID NO: 37206 - RNA, 21 nt, Homo sapiens
auauguauccugauugccagg

SEQ ID NO: 37207 - RNA, 17 nt, Homo sapiens
gacagggagggucaccu

SEQ ID NO: 37208 - RNA, 17 nt, Homo sapiens
caaaagcucucucccuu

SEQ ID NO: 37209 - RNA, 19 nt, Homo sapiens
ggagaaaauggguacauca

SEQ ID NO: 37210 - RNA, 20 nt, Homo sapiens
agaaugugauuaucugguug

SEQ ID NO: 37211 - RNA, 19 nt, Homo sapiens
gugggugggggaggaaguu

SEQ ID NO: 37212 - RNA, 19 nt, Homo sapiens
uauaacaauccaguccuca

SEQ ID NO: 37213 - RNA, 18 nt, Homo sapiens
uccaccuccuggguucaa

SEQ ID NO: 37214 - RNA, 16 nt, Homo sapiens
ucuaaaucgguagcau

SEQ ID NO: 37215 - RNA, 18 nt, Homo sapiens
ugaaaauucugccggcga

SEQ ID NO: 37216 - RNA, 21 nt, Homo sapiens
ugucuguggaaugagaaggga

SEQ ID NO: 37217 - RNA, 16 nt, Homo sapiens
aauggacuggaaauug

SEQ ID NO: 37218 - RNA, 20 nt, Homo sapiens
acauuacuuuagaagauaug

SEQ ID NO: 37219 - RNA, 16 nt, Homo sapiens
agugcauucugugcua

SEQ ID NO: 37220 - RNA, 17 nt, Homo sapiens
ucaugauccaucucugg

SEQ ID NO: 37221 - RNA, 20 nt, Homo sapiens
gagugcuccuugcucuguaa

SEQ ID NO: 37222 - RNA, 19 nt, Homo sapiens
gggcaucaaccucacccca

SEQ ID NO: 37223 - RNA, 18 nt, Homo sapiens
cgcagaccucacaacauc

SEQ ID NO: 37224 - RNA, 15 nt, Homo sapiens
aaacagggccacuug

SEQ ID NO: 37225 - RNA, 21 nt, Homo sapiens
agccacagggaccccaggaag

SEQ ID NO: 37226 - RNA, 20 nt, Homo sapiens
caaccuuagcccucuccccu

SEQ ID NO: 37227 - RNA, 16 nt, Homo sapiens
cccaaugucugcucca

SEQ ID NO: 37228 - RNA, 20 nt, Homo sapiens
ccugcuuccucuccaucuca

SEQ ID NO: 37229 - RNA, 19 nt, Homo sapiens
guccaggaaagaacagccu

SEQ ID NO: 37230 - RNA, 21 nt, Homo sapiens
guuucugcagccaguaaguca

SEQ ID NO: 37231 - RNA, 17 nt, Homo sapiens
ucuacggaagauguggc

SEQ ID NO: 37232 - RNA, 23 nt, Homo sapiens
uugaaccuaucuucucccugcuu

SEQ ID NO: 37233 - RNA, 26 nt, Homo sapiens
gccuccauccuccccuagagggguca

SEQ ID NO: 37234 - RNA, 29 nt, Homo sapiens
uauucaaguagaaaaguuaacuaaauggu

SEQ ID NO: 37235 - RNA, 20 nt, Homo sapiens
ugaaacguggugucugguuu

SEQ ID NO: 37236 - RNA, 22 nt, Homo sapiens
aaacuaauccuuagcuauccaa

SEQ ID NO: 37237 - RNA, 18 nt, Homo sapiens
acaacucuuaauuucuca

SEQ ID NO: 37238 - RNA, 21 nt, Homo sapiens
accauauuucuccccacucug

SEQ ID NO: 37239 - RNA, 21 nt, Homo sapiens
auguggagcagggccacguga

SEQ ID NO: 37240 - RNA, 23 nt, Homo sapiens
caaacagaccuccugcccaucca

SEQ ID NO: 37241 - RNA, 24 nt, Homo sapiens
cggggcgcaccccccacuaccucc

SEQ ID NO: 37242 - RNA, 18 nt, Homo sapiens
gcagcacagggcugcauc

SEQ ID NO: 37243 - RNA, 17 nt, Homo sapiens
gcccagaguccguccag

SEQ ID NO: 37244 - RNA, 22 nt, Homo sapiens
gcuucucugggucccacucucu

SEQ ID NO: 37245 - RNA, 30 nt, Homo sapiens
uacagccccacaaggucagcauccacauca

SEQ ID NO: 37246 - RNA, 21 nt, Homo sapiens
ugaagaguuuucugccaauga

SEQ ID NO: 37247 - RNA, 24 nt, Homo sapiens
ugagcacugacccacagcacuaca

SEQ ID NO: 37248 - RNA, 18 nt, Homo sapiens
uuccuagugaccauccag

SEQ ID NO: 37249 - RNA, 20 nt, Homo sapiens
uuuccaugucacagcuccac

SEQ ID NO: 37250 - RNA, 21 nt, Homo sapiens
ugcccaggcaaaagcagggaa

SEQ ID NO: 37251 - RNA, 19 nt, Homo sapiens
ccuggaggcugccaagggc

SEQ ID NO: 37252 - RNA, 20 nt, Homo sapiens
cuccaggccccgcacgugcu

SEQ ID NO: 37253 - RNA, 21 nt, Homo sapiens
uagacacaaacauauacgccu

SEQ ID NO: 37254 - RNA, 18 nt, Homo sapiens
uguuguggauuuauuuac

SEQ ID NO: 37255 - RNA, 21 nt, Homo sapiens
ucuaccucaccaucaauguca

SEQ ID NO: 37256 - RNA, 19 nt, Homo sapiens
ggaaaggcaggcagaggga

SEQ ID NO: 37257 - RNA, 22 nt, Homo sapiens
cuuuggugguuaagguuuguga

SEQ ID NO: 37258 - RNA, 21 nt, Homo sapiens
guuucuuccuguugauauuca

SEQ ID NO: 37259 - RNA, 22 nt, Homo sapiens
cccugugcaggggguucugugg

SEQ ID NO: 37260 - RNA, 22 nt, Homo sapiens
cgccauuacccucuucugcccc

SEQ ID NO: 37261 - RNA, 21 nt, Homo sapiens
gcaaagcacucaacagccacc

SEQ ID NO: 37262 - RNA, 21 nt, Homo sapiens
gcagguggagggcucuuccuc

SEQ ID NO: 37263 - RNA, 21 nt, Homo sapiens
gcucuuccuccaguggcucgu

SEQ ID NO: 37264 - RNA, 17 nt, Homo sapiens
acggcaaacgcggagcu

SEQ ID NO: 37265 - RNA, 19 nt, Homo sapiens
ucugaugaaugacuguccc

SEQ ID NO: 37266 - RNA, 19 nt, Homo sapiens
gcugcuuguucccauuuua

SEQ ID NO: 37267 - RNA, 17 nt, Homo sapiens
aaacagaagccacacug

SEQ ID NO: 37268 - RNA, 18 nt, Homo sapiens
aaacauccucaggcuucu

SEQ ID NO: 37269 - RNA, 18 nt, Homo sapiens
cuucugugaagcucccau

SEQ ID NO: 37270 - RNA, 21 nt, Homo sapiens
ucacacugguuccauuuccuu

SEQ ID NO: 37271 - RNA, 18 nt, Homo sapiens
gaaucaguguugggacuc

SEQ ID NO: 37272 - RNA, 17 nt, Homo sapiens
ucaagugauucuccugc

SEQ ID NO: 37273 - RNA, 18 nt, Homo sapiens
uccgccuccuggguucaa

SEQ ID NO: 37274 - RNA, 22 nt, Homo sapiens
uugcuccccaccucccaucccu

SEQ ID NO: 37275 - RNA, 20 nt, Homo sapiens
guggacggggagaacucuga

SEQ ID NO: 37276 - RNA, 19 nt, Homo sapiens
caagguauuugguggaagc

SEQ ID NO: 37277 - RNA, 17 nt, Homo sapiens
cccccucccagggguca

SEQ ID NO: 37278 - RNA, 17 nt, Homo sapiens
agggaagcccggggucu

SEQ ID NO: 37279 - RNA, 19 nt, Homo sapiens
cccgggcugcgccccagca

SEQ ID NO: 37280 - RNA, 21 nt, Homo sapiens
ccgcggaccuuccacaacgac

SEQ ID NO: 37281 - RNA, 21 nt, Homo sapiens
cagacaggucagagaccacug

SEQ ID NO: 37282 - RNA, 20 nt, Homo sapiens
caggguccagcuccuccuca

SEQ ID NO: 37283 - RNA, 22 nt, Homo sapiens
ccaacaagcuuaacacccacca

SEQ ID NO: 37284 - RNA, 23 nt, Homo sapiens
ggacagggagggagcaucccccu

SEQ ID NO: 37285 - RNA, 18 nt, Homo sapiens
ggaggaggaggccaggga

SEQ ID NO: 37286 - RNA, 20 nt, Homo sapiens
ggaggaggaggccagggaca

SEQ ID NO: 37287 - RNA, 20 nt, Homo sapiens
gugcaaauugcaggcacuga

SEQ ID NO: 37288 - RNA, 18 nt, Homo sapiens
uccuugugaaggcuguua

SEQ ID NO: 37289 - RNA, 22 nt, Homo sapiens
ugaagaacucagacucagagug

SEQ ID NO: 37290 - RNA, 21 nt, Homo sapiens
uuucggggcuacaaaggaucu

SEQ ID NO: 37291 - RNA, 20 nt, Homo sapiens
gaucauuggccuuuggacca

SEQ ID NO: 37292 - RNA, 20 nt, Homo sapiens
gcaaugcugccgggagcucu

SEQ ID NO: 37293 - RNA, 25 nt, Homo sapiens
ugaaguuugcacuggcaccuaccac

SEQ ID NO: 37294 - RNA, 21 nt, Homo sapiens
ccaguggcaggagcgccgcgc

SEQ ID NO: 37295 - RNA, 19 nt, Homo sapiens
ccggcugcggggccagugg

SEQ ID NO: 37296 - RNA, 20 nt, Homo sapiens
gagcauuaauguuuucugaa

SEQ ID NO: 37297 - RNA, 25 nt, Homo sapiens
gcgcccacacugacuagagccaacc

SEQ ID NO: 37298 - RNA, 22 nt, Homo sapiens
aagggagcgacugccugggguc

SEQ ID NO: 37299 - RNA, 19 nt, Homo sapiens
cuauuuuccacccugcaga

SEQ ID NO: 37300 - RNA, 20 nt, Homo sapiens
cuauuuuccacccugcagag

SEQ ID NO: 37301 - RNA, 17 nt, Homo sapiens
acugguggccagcgugg

SEQ ID NO: 37302 - RNA, 25 nt, Homo sapiens
agcggugaugagcuccacaccccca

SEQ ID NO: 37303 - RNA, 21 nt, Homo sapiens
aguggaggaaggugugcugug

SEQ ID NO: 37304 - RNA, 20 nt, Homo sapiens
caaccucuucauccugcccc

SEQ ID NO: 37305 - RNA, 19 nt, Homo sapiens
acacacaaacaaaauaaac

SEQ ID NO: 37306 - RNA, 24 nt, Homo sapiens
acacuucuaggguaaagcauuuua

SEQ ID NO: 37307 - RNA, 17 nt, Homo sapiens
auggauucauucuuuca

SEQ ID NO: 37308 - RNA, 20 nt, Homo sapiens
ccacacugacacacaaacaa

SEQ ID NO: 37309 - RNA, 21 nt, Homo sapiens
ccaggccugguccaugagaca

SEQ ID NO: 37310 - RNA, 18 nt, Homo sapiens
cccgcaaccuccgccucc

SEQ ID NO: 37311 - RNA, 18 nt, Homo sapiens
cuggccaaaacaaaaaca

SEQ ID NO: 37312 - RNA, 23 nt, Homo sapiens
gcucuuuuaggaguaucugggga

SEQ ID NO: 37313 - RNA, 23 nt, Homo sapiens
gucacucuuacacacuuuuuaca

SEQ ID NO: 37314 - RNA, 20 nt, Homo sapiens
ucaaacauccgcauucuccu

SEQ ID NO: 37315 - RNA, 21 nt, Homo sapiens
ugggcucaaaugcucucccca

SEQ ID NO: 37316 - RNA, 17 nt, Homo sapiens
uucuccugcuucugccu

SEQ ID NO: 37317 - RNA, 19 nt, Homo sapiens
ccuggccacaccuucucgg

SEQ ID NO: 37318 - RNA, 22 nt, Homo sapiens
cuugggcugcgucaagucacuu

SEQ ID NO: 37319 - RNA, 20 nt, Homo sapiens
ggacauuuucauagccuccu

SEQ ID NO: 37320 - RNA, 18 nt, Homo sapiens
cuuuaaauggaccaucca

SEQ ID NO: 37321 - RNA, 17 nt, Homo sapiens
uccuugccuugaucagg

SEQ ID NO: 37322 - RNA, 19 nt, Homo sapiens
ucgccacuuucuugcugcu

SEQ ID NO: 37323 - RNA, 22 nt, Homo sapiens
ccaccccaaugcccucaccugc

SEQ ID NO: 37324 - RNA, 22 nt, Homo sapiens
ccaccccaaugcccucaccugc

SEQ ID NO: 37325 - RNA, 22 nt, Homo sapiens
ccaccccaaugcccucaccugc

SEQ ID NO: 37326 - RNA, 22 nt, Homo sapiens
agaucucuggaaucguugcagg

SEQ ID NO: 37327 - RNA, 18 nt, Homo sapiens
gccaagagaaaaauauac

SEQ ID NO: 37328 - RNA, 22 nt, Homo sapiens
uacuacaguucccaugcucuga

SEQ ID NO: 37329 - RNA, 19 nt, Homo sapiens
agugcucauuuggauugca

SEQ ID NO: 37330 - RNA, 17 nt, Homo sapiens
aacaacguguucaagca

SEQ ID NO: 37331 - RNA, 18 nt, Homo sapiens
acuauuuuguuuuaugac

SEQ ID NO: 37332 - RNA, 18 nt, Homo sapiens
agcucacuaaaugugcug

SEQ ID NO: 37333 - RNA, 17 nt, Homo sapiens
ggcuuaacaugaaacug

SEQ ID NO: 37334 - RNA, 21 nt, Homo sapiens
uugaaauauauuuuugugaga

SEQ ID NO: 37335 - RNA, 20 nt, Homo sapiens
cuggagcuccacgcauccua

SEQ ID NO: 37336 - RNA, 18 nt, Homo sapiens
gacgguaccaccauccca

SEQ ID NO: 37337 - RNA, 23 nt, Homo sapiens
ggcugccaucaacacccacauca

SEQ ID NO: 37338 - RNA, 25 nt, Homo sapiens
uaccaccaucccagcugugaggcug

SEQ ID NO: 37339 - RNA, 20 nt, Homo sapiens
ccgugugggagaucugugag

SEQ ID NO: 37340 - RNA, 15 nt, Homo sapiens
aaugucauuuacugg

SEQ ID NO: 37341 - RNA, 17 nt, Homo sapiens
auuacaacaucugcuga

SEQ ID NO: 37342 - RNA, 16 nt, Homo sapiens
ggcgcuacggccgggu

SEQ ID NO: 37343 - RNA, 18 nt, Homo sapiens
gggaucaccugccuuuuu

SEQ ID NO: 37344 - RNA, 20 nt, Homo sapiens
cccugaagccacaagccuug

SEQ ID NO: 37345 - RNA, 19 nt, Homo sapiens
uuuucuugggugagcauga

SEQ ID NO: 37346 - RNA, 18 nt, Homo sapiens
gcgcuuaaaacauuguga

SEQ ID NO: 37347 - RNA, 22 nt, Homo sapiens
acuaauuauaagagaauucaua

SEQ ID NO: 37348 - RNA, 22 nt, Homo sapiens
aguuauaacggcaaauugcuga

SEQ ID NO: 37349 - RNA, 23 nt, Homo sapiens
ccaaacagugugcaaaacucaca

SEQ ID NO: 37350 - RNA, 19 nt, Homo sapiens
uuaaaguuauaacggcaaa

SEQ ID NO: 37351 - RNA, 22 nt, Homo sapiens
uuucuucuuuugcuauaauuuu

SEQ ID NO: 37352 - RNA, 25 nt, Homo sapiens
uuuuuuuaacaguugucuuguuuuu

SEQ ID NO: 37353 - RNA, 17 nt, Homo sapiens
ugaaggcuggaaaagag

SEQ ID NO: 37354 - RNA, 21 nt, Homo sapiens
cagcacauguuaacucuccuc

SEQ ID NO: 37355 - RNA, 18 nt, Homo sapiens
uauauugcuauugucacu

SEQ ID NO: 37356 - RNA, 16 nt, Homo sapiens
ccccaacucccuacca

SEQ ID NO: 37357 - RNA, 17 nt, Homo sapiens
ucuugcucaaaagaucu

SEQ ID NO: 37358 - RNA, 19 nt, Homo sapiens
gugucuagcacauacuaca

SEQ ID NO: 37359 - RNA, 20 nt, Homo sapiens
uucaagaccagccugaccaa

SEQ ID NO: 37360 - RNA, 18 nt, Homo sapiens
aagcucugaguuacuuuu

SEQ ID NO: 37361 - RNA, 19 nt, Homo sapiens
agaaggggacauacaggcc

SEQ ID NO: 37362 - RNA, 24 nt, Homo sapiens
auaaaacacaucagguuugcuuca

SEQ ID NO: 37363 - RNA, 20 nt, Homo sapiens
ccgaaagaggagccccugga

SEQ ID NO: 37364 - RNA, 22 nt, Homo sapiens
gaaaggauuugaguacaggaca

SEQ ID NO: 37365 - RNA, 18 nt, Homo sapiens
gacaauuccagcacucua

SEQ ID NO: 37366 - RNA, 17 nt, Homo sapiens
guaacuaaaucugcugc

SEQ ID NO: 37367 - RNA, 18 nt, Homo sapiens
uggcuucauuuucuacau

SEQ ID NO: 37368 - RNA, 19 nt, Homo sapiens
uguuucagaugugcaggga

SEQ ID NO: 37369 - RNA, 21 nt, Homo sapiens
auccccagcgcccugcgggcc

SEQ ID NO: 37370 - RNA, 17 nt, Homo sapiens
caggcuccucgucaccc

SEQ ID NO: 37371 - RNA, 17 nt, Homo sapiens
agugacaaacaugccuc

SEQ ID NO: 37372 - RNA, 21 nt, Homo sapiens
aucuuggcucacugcaaccuc

SEQ ID NO: 37373 - RNA, 18 nt, Homo sapiens
ccugcaaccuccaccucc

SEQ ID NO: 37374 - RNA, 18 nt, Homo sapiens
uccaccucccggguucaa

SEQ ID NO: 37375 - RNA, 23 nt, Homo sapiens
gucaaaauaguuuuggggaucac

SEQ ID NO: 37376 - RNA, 22 nt, Homo sapiens
uaaaugggaauucaugaaauua

SEQ ID NO: 37377 - RNA, 21 nt, Homo sapiens
aguaagauacccaaguccuca

SEQ ID NO: 37378 - RNA, 22 nt, Homo sapiens
caaggugaugucauugggccua

SEQ ID NO: 37379 - RNA, 22 nt, Homo sapiens
gaagaaaccuggaugaaccuaa

SEQ ID NO: 37380 - RNA, 18 nt, Homo sapiens
ugggaguaccucaggcgg

SEQ ID NO: 37381 - RNA, 21 nt, Homo sapiens
cuugucaaugaaaacacucug

SEQ ID NO: 37382 - RNA, 21 nt, Homo sapiens
cucugagucacggucugugag

SEQ ID NO: 37383 - RNA, 17 nt, Homo sapiens
gcggcugucggcuggca

SEQ ID NO: 37384 - RNA, 17 nt, Homo sapiens
agaagccacuccaguga

SEQ ID NO: 37385 - RNA, 21 nt, Homo sapiens
agucucacucugucacccagc

SEQ ID NO: 37386 - RNA, 18 nt, Homo sapiens
ccugaaacuccuuggcuu

SEQ ID NO: 37387 - RNA, 17 nt, Homo sapiens
gagccugagaaaucuua

SEQ ID NO: 37388 - RNA, 18 nt, Homo sapiens
ucuuggcucuuugaucuu

SEQ ID NO: 37389 - RNA, 18 nt, Homo sapiens
uuccagaagccacuccag

SEQ ID NO: 37390 - RNA, 22 nt, Homo sapiens
cccacucaccguccuugcugcu

SEQ ID NO: 37391 - RNA, 20 nt, Homo sapiens
aagaaugcucuuugucuucc

SEQ ID NO: 37392 - RNA, 20 nt, Homo sapiens
aagagguacccauaaaugau

SEQ ID NO: 37393 - RNA, 22 nt, Homo sapiens
ccgagaggagcccucuaccuug

SEQ ID NO: 37394 - RNA, 17 nt, Homo sapiens
agaccugaaacugcccc

SEQ ID NO: 37395 - RNA, 19 nt, Homo sapiens
aucugcauuugguguauca

SEQ ID NO: 37396 - RNA, 17 nt, Homo sapiens
gcuucggcuuuuggccu

SEQ ID NO: 37397 - RNA, 20 nt, Homo sapiens
ccucucaagaaaacacugga

SEQ ID NO: 37398 - RNA, 23 nt, Homo sapiens
cuuuuugaaauucgaggagcuga

SEQ ID NO: 37399 - RNA, 18 nt, Homo sapiens
agcucucaaaauuccuca

SEQ ID NO: 37400 - RNA, 19 nt, Homo sapiens
guuucuugaugucuuuugg

SEQ ID NO: 37401 - RNA, 21 nt, Homo sapiens
uccuuuuuuuuuuuuaacccc

SEQ ID NO: 37402 - RNA, 23 nt, Homo sapiens
ucuucaugcuacucuuaaccucc

SEQ ID NO: 37403 - RNA, 18 nt, Homo sapiens
acucuuaucgucaucuua

SEQ ID NO: 37404 - RNA, 18 nt, Homo sapiens
cucaaguuguuuuagucu

SEQ ID NO: 37405 - RNA, 19 nt, Homo sapiens
guuucuugaugucuuuugg

SEQ ID NO: 37406 - RNA, 19 nt, Homo sapiens
uugggcauuuucucucuca

SEQ ID NO: 37407 - RNA, 19 nt, Homo sapiens
accaucccaaguccuuugu

SEQ ID NO: 37408 - RNA, 20 nt, Homo sapiens
caguaaacuuucaaugcugc

SEQ ID NO: 37409 - RNA, 20 nt, Homo sapiens
ggaguacaacuacuauugua

SEQ ID NO: 37410 - RNA, 17 nt, Homo sapiens
uaacaccucaccauuga

SEQ ID NO: 37411 - RNA, 22 nt, Homo sapiens
uuuauuuauggcaguauucaua

SEQ ID NO: 37412 - RNA, 19 nt, Homo sapiens
aaggcuggggcugcagcca

SEQ ID NO: 37413 - RNA, 19 nt, Homo sapiens
ccugaaccaauuucuucca

SEQ ID NO: 37414 - RNA, 18 nt, Homo sapiens
uuucacuuguuuuuuaca

SEQ ID NO: 37415 - RNA, 21 nt, Homo sapiens
gucuccggcugcaccgagugg

SEQ ID NO: 37416 - RNA, 21 nt, Homo sapiens
accuaaaaaaugcaaauucca

SEQ ID NO: 37417 - RNA, 20 nt, Homo sapiens
auuguguuccucaaauucau

SEQ ID NO: 37418 - RNA, 25 nt, Homo sapiens
ccgggguaaaagaagcaugaccuca

SEQ ID NO: 37419 - RNA, 24 nt, Homo sapiens
uuuaggaaacaaagauggacuucu

SEQ ID NO: 37420 - RNA, 22 nt, Homo sapiens
uuucaucaauugccuugacuuu

SEQ ID NO: 37421 - RNA, 18 nt, Homo sapiens
cugugcaaaaauguuugu

SEQ ID NO: 37422 - RNA, 27 nt, Homo sapiens
gccugggcgcuggagcugcuguggcuc

SEQ ID NO: 37423 - RNA, 17 nt, Homo sapiens
aaaagcagcagcuacua

SEQ ID NO: 37424 - RNA, 20 nt, Homo sapiens
acaaaagcagcagcuacuac

SEQ ID NO: 37425 - RNA, 23 nt, Homo sapiens
ucuaguaugucucagguauuuuu

SEQ ID NO: 37426 - RNA, 19 nt, Homo sapiens
uaccaaugagagccucaca

SEQ ID NO: 37427 - RNA, 22 nt, Homo sapiens
acucuuuccccgccuucuuugu

SEQ ID NO: 37428 - RNA, 19 nt, Homo sapiens
ccugaaaaggaccagugga

SEQ ID NO: 37429 - RNA, 20 nt, Homo sapiens
uuuguuuauuccggacccac

SEQ ID NO: 37430 - RNA, 21 nt, Homo sapiens
cggggucuugguggguccagu

SEQ ID NO: 37431 - RNA, 18 nt, Homo sapiens
gcaggccuaagccggcca

SEQ ID NO: 37432 - RNA, 24 nt, Homo sapiens
gccccaggucaagggcucuuggga

SEQ ID NO: 37433 - RNA, 25 nt, Homo sapiens
gucugggccucugguugccuugucc

SEQ ID NO: 37434 - RNA, 16 nt, Homo sapiens
uccagugguaauggug

SEQ ID NO: 37435 - RNA, 22 nt, Homo sapiens
agggugcaccaggcccacccca

SEQ ID NO: 37436 - RNA, 22 nt, Homo sapiens
agggugcaccaggcccgcccca

SEQ ID NO: 37437 - RNA, 22 nt, Homo sapiens
agggugcaccaggcccgcccca

SEQ ID NO: 37438 - RNA, 22 nt, Homo sapiens
agggugcaccagggccacccca

SEQ ID NO: 37439 - RNA, 24 nt, Homo sapiens
auagugaauaagaugccucccaaa

SEQ ID NO: 37440 - RNA, 21 nt, Homo sapiens
cuauguaguauauacacacau

SEQ ID NO: 37441 - RNA, 20 nt, Homo sapiens
aaagaaucacagagcauaca

SEQ ID NO: 37442 - RNA, 21 nt, Homo sapiens
agcacccuggagacuuugcuc

SEQ ID NO: 37443 - RNA, 17 nt, Homo sapiens
auuuuaggcaaagaggu

SEQ ID NO: 37444 - RNA, 26 nt, Homo sapiens
caggguggacugugaccccuuggccu

SEQ ID NO: 37445 - RNA, 18 nt, Homo sapiens
gaggcaggaaacuacccc

SEQ ID NO: 37446 - RNA, 23 nt, Homo sapiens
gccugaggccgcugguagacuuu

SEQ ID NO: 37447 - RNA, 21 nt, Homo sapiens
ugcaaaaggagguaaguuucu

SEQ ID NO: 37448 - RNA, 21 nt, Homo sapiens
ucucaggccaagagcugcagg

SEQ ID NO: 37449 - RNA, 20 nt, Homo sapiens
caggugccugcacucgcugc

SEQ ID NO: 37450 - RNA, 19 nt, Homo sapiens
ccaggccgcccacguccca

SEQ ID NO: 37451 - RNA, 19 nt, Homo sapiens
cgugggagccgugcgggug

SEQ ID NO: 37452 - RNA, 21 nt, Homo sapiens
cuucuaguggacauuacugcu

SEQ ID NO: 37453 - RNA, 23 nt, Homo sapiens
ugaaggagcuucagcgccagcca

SEQ ID NO: 37454 - RNA, 20 nt, Homo sapiens
gcuucucugggcugugccuc

SEQ ID NO: 37455 - RNA, 22 nt, Homo sapiens
guguuuuuaccuuggugaaucu

SEQ ID NO: 37456 - RNA, 16 nt, Homo sapiens
caagauuuggcuccaa

SEQ ID NO: 37457 - RNA, 18 nt, Homo sapiens
agcuacagacaaaagcca

SEQ ID NO: 37458 - RNA, 23 nt, Homo sapiens
cagaggacuuuguccaagucuca

SEQ ID NO: 37459 - RNA, 22 nt, Homo sapiens
cugaagugacacuuuuuccaca

SEQ ID NO: 37460 - RNA, 22 nt, Homo sapiens
aaccaccacagucucugucaca

SEQ ID NO: 37461 - RNA, 20 nt, Homo sapiens
ccuggcacacacaggcaccc

SEQ ID NO: 37462 - RNA, 19 nt, Homo sapiens
gacacaugcacacacauca

SEQ ID NO: 37463 - RNA, 21 nt, Homo sapiens
caucauccugaggcuguguca

SEQ ID NO: 37464 - RNA, 21 nt, Homo sapiens
ggugaugcugacucgauggcc

SEQ ID NO: 37465 - RNA, 19 nt, Homo sapiens
uaaauggacuuauugaagc

SEQ ID NO: 37466 - RNA, 25 nt, Homo sapiens
uuccagacagaaccaguguacaucu

SEQ ID NO: 37467 - RNA, 19 nt, Homo sapiens
guuuuacagguuacuaaca

SEQ ID NO: 37468 - RNA, 21 nt, Homo sapiens
ucugaaauaagauuuuaugaa

SEQ ID NO: 37469 - RNA, 19 nt, Homo sapiens
aaggcaucccucaccucug

SEQ ID NO: 37470 - RNA, 18 nt, Homo sapiens
caucaucuggcugugaug

SEQ ID NO: 37471 - RNA, 20 nt, Homo sapiens
cccgaagcauaugguggagc

SEQ ID NO: 37472 - RNA, 19 nt, Homo sapiens
cuuaaagcucaucaugaaa

SEQ ID NO: 37473 - RNA, 19 nt, Homo sapiens
cuucuuggugugguuugua

SEQ ID NO: 37474 - RNA, 24 nt, Homo sapiens
gcccaugagucccugugcagacca

SEQ ID NO: 37475 - RNA, 20 nt, Homo sapiens
aguccuaaaauuggauccaa

SEQ ID NO: 37476 - RNA, 24 nt, Homo sapiens
gaaacuccgucucaaaacaaaaca

SEQ ID NO: 37477 - RNA, 16 nt, Homo sapiens
uucuuccuucaggugu

SEQ ID NO: 37478 - RNA, 20 nt, Homo sapiens
uuugucaucucaugauaaca

SEQ ID NO: 37479 - RNA, 24 nt, Homo sapiens
agaacgggacagagcagcugccca

SEQ ID NO: 37480 - RNA, 17 nt, Homo sapiens
cagcaaaugccagcaau

SEQ ID NO: 37481 - RNA, 19 nt, Homo sapiens
ccuuuccacuaaggacuca

SEQ ID NO: 37482 - RNA, 22 nt, Homo sapiens
ucucuucagcacccucagccuu

SEQ ID NO: 37483 - RNA, 20 nt, Homo sapiens
ugacacgggagcuagcagca

SEQ ID NO: 37484 - RNA, 19 nt, Homo sapiens
ugcccagagucauucccag

SEQ ID NO: 37485 - RNA, 19 nt, Homo sapiens
agaagaaacacuucccaca

SEQ ID NO: 37486 - RNA, 22 nt, Homo sapiens
ccugugacugauuuuagugaua

SEQ ID NO: 37487 - RNA, 18 nt, Homo sapiens
cuugguauccccuggucu

SEQ ID NO: 37488 - RNA, 19 nt, Homo sapiens
gcagagugaaggcauguca

SEQ ID NO: 37489 - RNA, 19 nt, Homo sapiens
uugaugaagaagaagauga

SEQ ID NO: 37490 - RNA, 21 nt, Homo sapiens
agggaagaaaacacaucccac

SEQ ID NO: 37491 - RNA, 17 nt, Homo sapiens
accuucacaguagugau

SEQ ID NO: 37492 - RNA, 20 nt, Homo sapiens
ccucugccucccagguucaa

SEQ ID NO: 37493 - RNA, 19 nt, Homo sapiens
cugcaaccucugccuccca

SEQ ID NO: 37494 - RNA, 21 nt, Homo sapiens
guacuugauaggauuaugaua

SEQ ID NO: 37495 - RNA, 18 nt, Homo sapiens
guuguaacagaagaguga

SEQ ID NO: 37496 - RNA, 20 nt, Homo sapiens
uagguggaccugcuugaggu

SEQ ID NO: 37497 - RNA, 17 nt, Homo sapiens
ucaagugauucuccugc

SEQ ID NO: 37498 - RNA, 19 nt, Homo sapiens
cuggcaggaaauuugcaaa

SEQ ID NO: 37499 - RNA, 26 nt, Homo sapiens
uccuauaaacagaaugggcgaccaau

SEQ ID NO: 37500 - RNA, 18 nt, Homo sapiens
gugaaaauuauugcgugc

SEQ ID NO: 37501 - RNA, 17 nt, Homo sapiens
ugaucaaguccuugcua

SEQ ID NO: 37502 - RNA, 21 nt, Homo sapiens
ugucucuccugcacacauagc

SEQ ID NO: 37503 - RNA, 18 nt, Homo sapiens
auguggaugaaaaacaga

SEQ ID NO: 37504 - RNA, 19 nt, Homo sapiens
caaagaaacguggaaucca

SEQ ID NO: 37505 - RNA, 18 nt, Homo sapiens
cuacuucccucuccaccu

SEQ ID NO: 37506 - RNA, 19 nt, Homo sapiens
cucuccuucaagcugucug

SEQ ID NO: 37507 - RNA, 19 nt, Homo sapiens
gggaggagggugacaccca

SEQ ID NO: 37508 - RNA, 19 nt, Homo sapiens
ucugucccuugcucuccuu

SEQ ID NO: 37509 - RNA, 22 nt, Homo sapiens
aagaagagggaaaagccauaga

SEQ ID NO: 37510 - RNA, 19 nt, Homo sapiens
auguuacuguugucacacc

SEQ ID NO: 37511 - RNA, 17 nt, Homo sapiens
caacaccucuauaguga

SEQ ID NO: 37512 - RNA, 19 nt, Homo sapiens
gaaguaaaauauggcacag

SEQ ID NO: 37513 - RNA, 18 nt, Homo sapiens
gcuggaguacucugguga

SEQ ID NO: 37514 - RNA, 19 nt, Homo sapiens
uauggcacagagcauugaa

SEQ ID NO: 37515 - RNA, 19 nt, Homo sapiens
uccaauggccaaaaucugc

SEQ ID NO: 37516 - RNA, 24 nt, Homo sapiens
ugccuuugaccauccucaaagcca

SEQ ID NO: 37517 - RNA, 22 nt, Homo sapiens
gccaaaccuacuaacaacacug

SEQ ID NO: 37518 - RNA, 22 nt, Homo sapiens
gagcacccucccugcccgucuu

SEQ ID NO: 37519 - RNA, 22 nt, Homo sapiens
aacucuucuaaggaaggacaca

SEQ ID NO: 37520 - RNA, 19 nt, Homo sapiens
ccugucucaacuaauaaua

SEQ ID NO: 37521 - RNA, 22 nt, Homo sapiens
gagccaagaucguaccacugca

SEQ ID NO: 37522 - RNA, 24 nt, Homo sapiens
uagaugguuucccagugugagauu

SEQ ID NO: 37523 - RNA, 20 nt, Homo sapiens
acuggugcagcugcuggcca

SEQ ID NO: 37524 - RNA, 21 nt, Homo sapiens
cacaucgccgccuuguuccuc

SEQ ID NO: 37525 - RNA, 18 nt, Homo sapiens
gugggcacguuuuuggaa

SEQ ID NO: 37526 - RNA, 18 nt, Homo sapiens
ucccugcagggauuucac

SEQ ID NO: 37527 - RNA, 19 nt, Homo sapiens
aggucucgccauauugcuc

SEQ ID NO: 37528 - RNA, 23 nt, Homo sapiens
augggcacgugcccagaacacac

SEQ ID NO: 37529 - RNA, 21 nt, Homo sapiens
cgaggcugcagugagcuguga

SEQ ID NO: 37530 - RNA, 17 nt, Homo sapiens
ccuuaauuacauuuuug

SEQ ID NO: 37531 - RNA, 20 nt, Homo sapiens
uauccauuuguuugauuaca

SEQ ID NO: 37532 - RNA, 18 nt, Homo sapiens
acccaccucgcuuucuca

SEQ ID NO: 37533 - RNA, 20 nt, Homo sapiens
agaucaccgcaggcggguuu

SEQ ID NO: 37534 - RNA, 21 nt, Homo sapiens
auagcaagugauccugcgaua

SEQ ID NO: 37535 - RNA, 18 nt, Homo sapiens
acggugacggccuggccc

SEQ ID NO: 37536 - RNA, 19 nt, Homo sapiens
acccagaaacaaaaaucuc

SEQ ID NO: 37537 - RNA, 17 nt, Homo sapiens
cauacuacuauuccuuu

SEQ ID NO: 37538 - RNA, 17 nt, Homo sapiens
caguaagccaagaaaaa

SEQ ID NO: 37539 - RNA, 23 nt, Homo sapiens
cagugagacuguacauaauugca

SEQ ID NO: 37540 - RNA, 17 nt, Homo sapiens
cuacugauguuguugau

SEQ ID NO: 37541 - RNA, 20 nt, Homo sapiens
cagaucccauccugcuccuc

SEQ ID NO: 37542 - RNA, 20 nt, Homo sapiens
cagaucccauccugcuccuc

SEQ ID NO: 37543 - RNA, 20 nt, Homo sapiens
cagaucccauccugcuccuc

SEQ ID NO: 37544 - RNA, 21 nt, Homo sapiens
cgaggcugcagugagcuguga

SEQ ID NO: 37545 - RNA, 18 nt, Homo sapiens
gccuauugugggacuuca

SEQ ID NO: 37546 - RNA, 18 nt, Homo sapiens
uaaguuuuuagugagugu

SEQ ID NO: 37547 - RNA, 20 nt, Homo sapiens
ugugauugcaccacugcacu

SEQ ID NO: 37548 - RNA, 20 nt, Homo sapiens
aucucuuaaaaugaaaugaa

SEQ ID NO: 37549 - RNA, 19 nt, Homo sapiens
aucugaguuaggcuuggcc

SEQ ID NO: 37550 - RNA, 22 nt, Homo sapiens
gcacuuuaagggaugauuaugu

SEQ ID NO: 37551 - RNA, 19 nt, Homo sapiens
uauagagacuauuuaacca

SEQ ID NO: 37552 - RNA, 19 nt, Homo sapiens
uauaguuacuggcauuagg

SEQ ID NO: 37553 - RNA, 23 nt, Homo sapiens
ucugcugauguccugaccaugga

SEQ ID NO: 37554 - RNA, 19 nt, Homo sapiens
guaaucagauguguagcaa

SEQ ID NO: 37555 - RNA, 23 nt, Homo sapiens
uccagcagaggaccucccaccca

SEQ ID NO: 37556 - RNA, 21 nt, Homo sapiens
uuccuauugacaucuacugcu

SEQ ID NO: 37557 - RNA, 21 nt, Homo sapiens
uuuuuaugccuucuuaacuuu

SEQ ID NO: 37558 - RNA, 18 nt, Homo sapiens
acccaucuccguagcagu

SEQ ID NO: 37559 - RNA, 18 nt, Homo sapiens
caaacagaagggaaaaca

SEQ ID NO: 37560 - RNA, 22 nt, Homo sapiens
ggaauucagucuuuaucauuga

SEQ ID NO: 37561 - RNA, 20 nt, Homo sapiens
caguucuuuggaaucacccu

SEQ ID NO: 37562 - RNA, 21 nt, Homo sapiens
cuuuggguugucuuuggccuu

SEQ ID NO: 37563 - RNA, 20 nt, Homo sapiens
gagacagugucugaaacagg

SEQ ID NO: 37564 - RNA, 22 nt, Homo sapiens
cuugccaucuccuuuucacuuc

SEQ ID NO: 37565 - RNA, 17 nt, Homo sapiens
aucuugaucuuuggcuu

SEQ ID NO: 37566 - RNA, 18 nt, Homo sapiens
auucuuuagaauccccca

SEQ ID NO: 37567 - RNA, 22 nt, Homo sapiens
cuggccucaagugauccuucca

SEQ ID NO: 37568 - RNA, 20 nt, Homo sapiens
gaaaauuuguaaagccacau

SEQ ID NO: 37569 - RNA, 21 nt, Homo sapiens
ugcacaggucaucccgcuccc

SEQ ID NO: 37570 - RNA, 18 nt, Homo sapiens
agacuauaugcuggugcu

SEQ ID NO: 37571 - RNA, 19 nt, Homo sapiens
agugagugggggagaaaug

SEQ ID NO: 37572 - RNA, 19 nt, Homo sapiens
ccagagcaagaaaagcuga

SEQ ID NO: 37573 - RNA, 20 nt, Homo sapiens
ccgugugcagcaccuuccuc

SEQ ID NO: 37574 - RNA, 19 nt, Homo sapiens
gaguacagcagcuaagaaa

SEQ ID NO: 37575 - RNA, 24 nt, Homo sapiens
gaggaaauaauacagauuuuggcu

SEQ ID NO: 37576 - RNA, 21 nt, Homo sapiens
ugcucucuguacaugauacug

SEQ ID NO: 37577 - RNA, 18 nt, Homo sapiens
acguuccaaauacauuau

SEQ ID NO: 37578 - RNA, 25 nt, Homo sapiens
agcuaccuccucuccacacugggga

SEQ ID NO: 37579 - RNA, 18 nt, Homo sapiens
cugccuugccagccugcu

SEQ ID NO: 37580 - RNA, 21 nt, Homo sapiens
gguucugacucugucacccag

SEQ ID NO: 37581 - RNA, 22 nt, Homo sapiens
guccagagacaggcccuccucc

SEQ ID NO: 37582 - RNA, 19 nt, Homo sapiens
ucagugggguucaccuuca

SEQ ID NO: 37583 - RNA, 20 nt, Homo sapiens
aaacacugucaaggauuuca

SEQ ID NO: 37584 - RNA, 18 nt, Homo sapiens
acguuccaaauacauuau

SEQ ID NO: 37585 - RNA, 25 nt, Homo sapiens
agcuaccuccucuccacacugggga

SEQ ID NO: 37586 - RNA, 18 nt, Homo sapiens
cugccuugccagccugcu

SEQ ID NO: 37587 - RNA, 21 nt, Homo sapiens
gguucugacucugucacccag

SEQ ID NO: 37588 - RNA, 19 nt, Homo sapiens
ucagugggguucaccuuca

SEQ ID NO: 37589 - RNA, 25 nt, Homo sapiens
ugagcucucuauucuguuucauuga

SEQ ID NO: 37590 - RNA, 18 nt, Homo sapiens
uuugcuauuuauucuugu

SEQ ID NO: 37591 - RNA, 16 nt, Homo sapiens
ucaaacagauguugua

SEQ ID NO: 37592 - RNA, 18 nt, Homo sapiens
ugcugaggugacuguuga

SEQ ID NO: 37593 - RNA, 18 nt, Homo sapiens
aaguggugauuuuugguu

SEQ ID NO: 37594 - RNA, 18 nt, Homo sapiens
acucaggcccagguccca

SEQ ID NO: 37595 - RNA, 19 nt, Homo sapiens
ccaacucagucuucaguga

SEQ ID NO: 37596 - RNA, 19 nt, Homo sapiens
ccuccacucccuuguugcu

SEQ ID NO: 37597 - RNA, 19 nt, Homo sapiens
cuagggcugccuuugcuuu

SEQ ID NO: 37598 - RNA, 23 nt, Homo sapiens
guuugaauugcccaaaguugccc

SEQ ID NO: 37599 - RNA, 23 nt, Homo sapiens
ucccacaacaauggcuaaccaau

SEQ ID NO: 37600 - RNA, 21 nt, Homo sapiens
uccuggugguggagguggggg

SEQ ID NO: 37601 - RNA, 21 nt, Homo sapiens
ccuuggcgacuuuuucuuugu

SEQ ID NO: 37602 - RNA, 22 nt, Homo sapiens
uugugguggggagaaaaagcua

SEQ ID NO: 37603 - RNA, 19 nt, Homo sapiens
aaaggguggaagaaccauc

SEQ ID NO: 37604 - RNA, 18 nt, Homo sapiens
aggguggaagaaccauca

SEQ ID NO: 37605 - RNA, 21 nt, Homo sapiens
auccaucaucuucaaaggcua

SEQ ID NO: 37606 - RNA, 23 nt, Homo sapiens
caucugcaaugguuguggaccug

SEQ ID NO: 37607 - RNA, 24 nt, Homo sapiens
cuuuuuuguccuugcuuuuaccuu

SEQ ID NO: 37608 - RNA, 17 nt, Homo sapiens
gcccagaaguggcccag

SEQ ID NO: 37609 - RNA, 23 nt, Homo sapiens
gggugaugcuuccaagcugacca

SEQ ID NO: 37610 - RNA, 21 nt, Homo sapiens
ucacuauuaaauaaacagucc

SEQ ID NO: 37611 - RNA, 17 nt, Homo sapiens
acuucggcugucugccu

SEQ ID NO: 37612 - RNA, 23 nt, Homo sapiens
auccaagugacuuuaaaucugcc

SEQ ID NO: 37613 - RNA, 22 nt, Homo sapiens
ccucugagcacuugggcagcca

SEQ ID NO: 37614 - RNA, 20 nt, Homo sapiens
cccauuccugccgccggcga

SEQ ID NO: 37615 - RNA, 21 nt, Homo sapiens
aacaauguuugagaaccucug

SEQ ID NO: 37616 - RNA, 20 nt, Homo sapiens
agugaugcugugauaccuua

SEQ ID NO: 37617 - RNA, 18 nt, Homo sapiens
cagugcugcuguaacuga

SEQ ID NO: 37618 - RNA, 19 nt, Homo sapiens
ccuauaguugacaauucug

SEQ ID NO: 37619 - RNA, 17 nt, Homo sapiens
gaaaaagaacaacauca

SEQ ID NO: 37620 - RNA, 17 nt, Homo sapiens
gccacaccucagccucc

SEQ ID NO: 37621 - RNA, 22 nt, Homo sapiens
gcguuagcaacacugcucacca

SEQ ID NO: 37622 - RNA, 20 nt, Homo sapiens
gcaccucuguuuucccuucu

SEQ ID NO: 37623 - RNA, 19 nt, Homo sapiens
acuucagagcccgcccucu

SEQ ID NO: 37624 - RNA, 24 nt, Homo sapiens
agauucuaguucucaaccucucca

SEQ ID NO: 37625 - RNA, 21 nt, Homo sapiens
gcccccccacacccuccuuca

SEQ ID NO: 37626 - RNA, 19 nt, Homo sapiens
ggacugugaucccuggccc

SEQ ID NO: 37627 - RNA, 20 nt, Homo sapiens
ggcuuccgugaucccguuuu

SEQ ID NO: 37628 - RNA, 19 nt, Homo sapiens
ccuucccaguuucucccca

SEQ ID NO: 37629 - RNA, 20 nt, Homo sapiens
uaaaaacagguaagcugcua

SEQ ID NO: 37630 - RNA, 18 nt, Homo sapiens
auuaagaaugaagcugau

SEQ ID NO: 37631 - RNA, 24 nt, Homo sapiens
aacauacccacaaaugccuaugau

SEQ ID NO: 37632 - RNA, 22 nt, Homo sapiens
caagcuuuguagugguugcaca

SEQ ID NO: 37633 - RNA, 21 nt, Homo sapiens
uuugcagggagauuucugaug

SEQ ID NO: 37634 - RNA, 19 nt, Homo sapiens
ccuugucaagacugucaaa

SEQ ID NO: 37635 - RNA, 21 nt, Homo sapiens
gauggcuuugccacaccaggc

SEQ ID NO: 37636 - RNA, 21 nt, Homo sapiens
gccugcacagaucucugguuc

SEQ ID NO: 37637 - RNA, 18 nt, Homo sapiens
ugaagagagaucuuagag

SEQ ID NO: 37638 - RNA, 21 nt, Homo sapiens
cacggccaccauggcguauca

SEQ ID NO: 37639 - RNA, 20 nt, Homo sapiens
ccuucuugcaaccucuuccc

SEQ ID NO: 37640 - RNA, 18 nt, Homo sapiens
cuggguaccgccagaaga

SEQ ID NO: 37641 - RNA, 19 nt, Homo sapiens
gaaguuuaacaaaacccga

SEQ ID NO: 37642 - RNA, 23 nt, Homo sapiens
gcuuacguugccaugaucccuca

SEQ ID NO: 37643 - RNA, 24 nt, Homo sapiens
aaucuuuuucuugaaauuaccucc

SEQ ID NO: 37644 - RNA, 16 nt, Homo sapiens
ccuggacuaucagcag

SEQ ID NO: 37645 - RNA, 22 nt, Homo sapiens
gaaugaugcaaugaaagaauuu

SEQ ID NO: 37646 - RNA, 20 nt, Homo sapiens
uagcaaaaugcauuuaaaua

SEQ ID NO: 37647 - RNA, 19 nt, Homo sapiens
uauuacucauuuuucuuga

SEQ ID NO: 37648 - RNA, 20 nt, Homo sapiens
uugaaaagauuuuaucagga

SEQ ID NO: 37649 - RNA, 19 nt, Homo sapiens
aaacuucugaccucaggug

SEQ ID NO: 37650 - RNA, 20 nt, Homo sapiens
ccuccaaaccuucagaccuc

SEQ ID NO: 37651 - RNA, 20 nt, Homo sapiens
gcaaugauugaaccacuucu

SEQ ID NO: 37652 - RNA, 22 nt, Homo sapiens
gguaguggggaggcaaguugug

SEQ ID NO: 37653 - RNA, 23 nt, Homo sapiens
uaggaaacaggauugggccuguu

SEQ ID NO: 37654 - RNA, 18 nt, Homo sapiens
uccuuucugaacacugga

SEQ ID NO: 37655 - RNA, 21 nt, Homo sapiens
ugugaaaaauguguuuuugga

SEQ ID NO: 37656 - RNA, 22 nt, Homo sapiens
aaaaugauagguaaaaagaucu

SEQ ID NO: 37657 - RNA, 21 nt, Homo sapiens
aaacauuucaggauuuaaauu

SEQ ID NO: 37658 - RNA, 20 nt, Homo sapiens
aacauuucaggauuuaaauu

SEQ ID NO: 37659 - RNA, 17 nt, Homo sapiens
aauuuuuggauucuggg

SEQ ID NO: 37660 - RNA, 22 nt, Homo sapiens
gccgagucauaucaugaugcca

SEQ ID NO: 37661 - RNA, 22 nt, Homo sapiens
uacuuuuuauguaucauugcua

SEQ ID NO: 37662 - RNA, 20 nt, Homo sapiens
ucaaaugugcacauucuuua

SEQ ID NO: 37663 - RNA, 24 nt, Homo sapiens
ugugaugauguauaccaacuauaa

SEQ ID NO: 37664 - RNA, 23 nt, Homo sapiens
aauauuuuuuaaagcacuacuca

SEQ ID NO: 37665 - RNA, 22 nt, Homo sapiens
agacaauacaguuauuaacaua

SEQ ID NO: 37666 - RNA, 19 nt, Homo sapiens
caaccuuagaaaagacaau

SEQ ID NO: 37667 - RNA, 26 nt, Homo sapiens
ccaaaucuaucugaguuguauaccca

SEQ ID NO: 37668 - RNA, 19 nt, Homo sapiens
ccccgccccccgucacugc

SEQ ID NO: 37669 - RNA, 25 nt, Homo sapiens
ccucuuacaagcugcuuuuggcuuu

SEQ ID NO: 37670 - RNA, 21 nt, Homo sapiens
gagcaagcuguccugagccca

SEQ ID NO: 37671 - RNA, 20 nt, Homo sapiens
guaugcuauaggcaucauuc

SEQ ID NO: 37672 - RNA, 20 nt, Homo sapiens
uacaagcugcuuuuggcuuu

SEQ ID NO: 37673 - RNA, 18 nt, Homo sapiens
cuugccugcacuucuuga

SEQ ID NO: 37674 - RNA, 21 nt, Homo sapiens
uucacuugcuccuucacuucc

SEQ ID NO: 37675 - RNA, 25 nt, Homo sapiens
caagaagucugggcuggguccaguc

SEQ ID NO: 37676 - RNA, 18 nt, Homo sapiens
acaccgucagcgcuccca

SEQ ID NO: 37677 - RNA, 19 nt, Homo sapiens
cccccaagggucuucccac

SEQ ID NO: 37678 - RNA, 17 nt, Homo sapiens
ccuggaaggugauggug

SEQ ID NO: 37679 - RNA, 17 nt, Homo sapiens
cuccccuuuuucaucug

SEQ ID NO: 37680 - RNA, 21 nt, Homo sapiens
cuccccuuuuucaucugcaca

SEQ ID NO: 37681 - RNA, 21 nt, Homo sapiens
gaggagggggcuccaaugaca

SEQ ID NO: 37682 - RNA, 21 nt, Homo sapiens
agaagaacuuagggagcgaga

SEQ ID NO: 37683 - RNA, 19 nt, Homo sapiens
aagcaauucuccugccuca

SEQ ID NO: 37684 - RNA, 18 nt, Homo sapiens
cccgcaaccuccgccccc

SEQ ID NO: 37685 - RNA, 18 nt, Homo sapiens
gauucucuuuuguccaca

SEQ ID NO: 37686 - RNA, 22 nt, Homo sapiens
ugaauuuucauucugccauuga

SEQ ID NO: 37687 - RNA, 19 nt, Homo sapiens
auccugaaacaccaggaga

SEQ ID NO: 37688 - RNA, 18 nt, Homo sapiens
auuugaaguuuuguucca

SEQ ID NO: 37689 - RNA, 20 nt, Homo sapiens
cacgcaucacagccauuuga

SEQ ID NO: 37690 - RNA, 19 nt, Homo sapiens
cagcuuucaagaaacauug

SEQ ID NO: 37691 - RNA, 18 nt, Homo sapiens
ccaauccaggcagugagg

SEQ ID NO: 37692 - RNA, 18 nt, Homo sapiens
ccacccuccuccaccucc

SEQ ID NO: 37693 - RNA, 20 nt, Homo sapiens
cggccucccgucuuuccuga

SEQ ID NO: 37694 - RNA, 21 nt, Homo sapiens
ggacccaggccagcugccaca

SEQ ID NO: 37695 - RNA, 17 nt, Homo sapiens
ggagucaggaugggaca

SEQ ID NO: 37696 - RNA, 20 nt, Homo sapiens
gggcggggugggauuuuugc

SEQ ID NO: 37697 - RNA, 20 nt, Homo sapiens
uccucuccuccgggccccuc

SEQ ID NO: 37698 - RNA, 21 nt, Homo sapiens
ugaggaacugaggccacguca

SEQ ID NO: 37699 - RNA, 20 nt, Homo sapiens
uguucccuucccugaccuca

SEQ ID NO: 37700 - RNA, 18 nt, Homo sapiens
ccugcaaccuccaccucc

SEQ ID NO: 37701 - RNA, 17 nt, Homo sapiens
uucuccugccuuagccu

SEQ ID NO: 37702 - RNA, 18 nt, Homo sapiens
aaaagguaccugaggaug

SEQ ID NO: 37703 - RNA, 18 nt, Homo sapiens
aaacaccugaagaucuca

SEQ ID NO: 37704 - RNA, 20 nt, Homo sapiens
cuuucucucucauagucuua

SEQ ID NO: 37705 - RNA, 20 nt, Homo sapiens
gaaaggauaaaugcuccuuu

SEQ ID NO: 37706 - RNA, 20 nt, Homo sapiens
ucaguugcacacguguacgu

SEQ ID NO: 37707 - RNA, 18 nt, Homo sapiens
aagugcagcaugggacua

SEQ ID NO: 37708 - RNA, 18 nt, Homo sapiens
acauuggauggcaauaca

SEQ ID NO: 37709 - RNA, 22 nt, Homo sapiens
ccuaguugggaggucugacgga

SEQ ID NO: 37710 - RNA, 21 nt, Homo sapiens
ggaguuugaggacaugcaaua

SEQ ID NO: 37711 - RNA, 22 nt, Homo sapiens
ucaucuuugaggccagaacagc

SEQ ID NO: 37712 - RNA, 22 nt, Homo sapiens
uguagggguggugccaagggug

SEQ ID NO: 37713 - RNA, 18 nt, Homo sapiens
acuuugacccuuuggccc

SEQ ID NO: 37714 - RNA, 16 nt, Homo sapiens
ccuggcccuucccacu

SEQ ID NO: 37715 - RNA, 17 nt, Homo sapiens
gaccccggguggggcug

SEQ ID NO: 37716 - RNA, 18 nt, Homo sapiens
gagcccccaaauguucca

SEQ ID NO: 37717 - RNA, 20 nt, Homo sapiens
cucugauggcaaucuuugga

SEQ ID NO: 37718 - RNA, 22 nt, Homo sapiens
gcagugucuagaauuuuuguua

SEQ ID NO: 37719 - RNA, 17 nt, Homo sapiens
gcccagacgcuuguccc

SEQ ID NO: 37720 - RNA, 17 nt, Homo sapiens
aaacgcaaagguuugca

SEQ ID NO: 37721 - RNA, 20 nt, Homo sapiens
cucaaaaacgcaaagguuug

SEQ ID NO: 37722 - RNA, 17 nt, Homo sapiens
gacaaagacuuggcuca

SEQ ID NO: 37723 - RNA, 23 nt, Homo sapiens
gaugccccucugagccuuccucc

SEQ ID NO: 37724 - RNA, 17 nt, Homo sapiens
gggacggcugccacucc

SEQ ID NO: 37725 - RNA, 20 nt, Homo sapiens
ugagccuuccuccccccuca

SEQ ID NO: 37726 - RNA, 18 nt, Homo sapiens
auccugaaugaacagugg

SEQ ID NO: 37727 - RNA, 17 nt, Homo sapiens
cuuccccuccuccuucc

SEQ ID NO: 37728 - RNA, 21 nt, Homo sapiens
gagaaaggggccguggucagc

SEQ ID NO: 37729 - RNA, 23 nt, Homo sapiens
gccuggauuuguauccuuggcuu

SEQ ID NO: 37730 - RNA, 18 nt, Homo sapiens
cuuuugcggcuccggcgu

SEQ ID NO: 37731 - RNA, 22 nt, Homo sapiens
uccucuaacuuaauaggacuua

SEQ ID NO: 37732 - RNA, 20 nt, Homo sapiens
agcaucuguuccuucugaga

SEQ ID NO: 37733 - RNA, 19 nt, Homo sapiens
aaguaggccuggagccuca

SEQ ID NO: 37734 - RNA, 17 nt, Homo sapiens
agcuucuguaaaucuca

SEQ ID NO: 37735 - RNA, 22 nt, Homo sapiens
ccaaguuucuugaguugcugcu

SEQ ID NO: 37736 - RNA, 16 nt, Homo sapiens
cggucuucugaaguau

SEQ ID NO: 37737 - RNA, 22 nt, Homo sapiens
gauaggagguaagugaccauua

SEQ ID NO: 37738 - RNA, 18 nt, Homo sapiens
gcuucuguaaaucucauu

SEQ ID NO: 37739 - RNA, 18 nt, Homo sapiens
ugcuguuagcugaacugu

SEQ ID NO: 37740 - RNA, 17 nt, Homo sapiens
uuuaagcagucuaugca

SEQ ID NO: 37741 - RNA, 24 nt, Homo sapiens
uuuucauguuguaucacacuguca

SEQ ID NO: 37742 - RNA, 20 nt, Homo sapiens
cuucagggcuucuugguuuu

SEQ ID NO: 37743 - RNA, 18 nt, Homo sapiens
gcaaggaagaugcugcca

SEQ ID NO: 37744 - RNA, 18 nt, Homo sapiens
aaagauccccuccuuccu

SEQ ID NO: 37745 - RNA, 21 nt, Homo sapiens
cacagugauuuagccaaauaa

SEQ ID NO: 37746 - RNA, 19 nt, Homo sapiens
ccuccuuccuaacguuuuu

SEQ ID NO: 37747 - RNA, 22 nt, Homo sapiens
cgggauuccugggguccagcca

SEQ ID NO: 37748 - RNA, 20 nt, Homo sapiens
ggauguugguacuccuccca

SEQ ID NO: 37749 - RNA, 17 nt, Homo sapiens
uuuguuugaggcuuucu

SEQ ID NO: 37750 - RNA, 24 nt, Homo sapiens
acacagugucguccaacaaccuga

SEQ ID NO: 37751 - RNA, 19 nt, Homo sapiens
ccucugucacacaggagca

SEQ ID NO: 37752 - RNA, 21 nt, Homo sapiens
cucugcagugucccauccacc

SEQ ID NO: 37753 - RNA, 20 nt, Homo sapiens
uucaagaccagccugaccaa

SEQ ID NO: 37754 - RNA, 17 nt, Homo sapiens
aaaggguguggccccuu

SEQ ID NO: 37755 - RNA, 18 nt, Homo sapiens
aagaacaccuaccucuau

SEQ ID NO: 37756 - RNA, 16 nt, Homo sapiens
agcuuccugagaucuc

SEQ ID NO: 37757 - RNA, 18 nt, Homo sapiens
agucgaugauaugagaaa

SEQ ID NO: 37758 - RNA, 18 nt, Homo sapiens
auccaggacaucucuuua

SEQ ID NO: 37759 - RNA, 19 nt, Homo sapiens
ccacccucacccugccaga

SEQ ID NO: 37760 - RNA, 20 nt, Homo sapiens
gugagaagugagagaucuga

SEQ ID NO: 37761 - RNA, 20 nt, Homo sapiens
ucuugccaccuccucugcac

SEQ ID NO: 37762 - RNA, 20 nt, Homo sapiens
cuuguuugaagacuugugga

SEQ ID NO: 37763 - RNA, 21 nt, Homo sapiens
aacuucagcacacguguguua

SEQ ID NO: 37764 - RNA, 19 nt, Homo sapiens
ccuucccaguuucucccca

SEQ ID NO: 37765 - RNA, 21 nt, Homo sapiens
cuguguauuacccuugcuuuu

SEQ ID NO: 37766 - RNA, 17 nt, Homo sapiens
gcaaccucagccaauga

SEQ ID NO: 37767 - RNA, 17 nt, Homo sapiens
aggcaggauaaucacuu

SEQ ID NO: 37768 - RNA, 21 nt, Homo sapiens
acuuggguuucaugccugccc

SEQ ID NO: 37769 - RNA, 25 nt, Homo sapiens
cucugcgccuccggcacucugguga

SEQ ID NO: 37770 - RNA, 21 nt, Homo sapiens
ugcccagggcuucugcuccgg

SEQ ID NO: 37771 - RNA, 20 nt, Homo sapiens
uugcaauuugcaagcuucuu

SEQ ID NO: 37772 - RNA, 23 nt, Homo sapiens
aagccaggaaggcccagucccuc

SEQ ID NO: 37773 - RNA, 18 nt, Homo sapiens
cucuccuuccguuucuga

SEQ ID NO: 37774 - RNA, 17 nt, Homo sapiens
gacagccaggcccaucu

SEQ ID NO: 37775 - RNA, 18 nt, Homo sapiens
ggcuuuauuaaauuugua

SEQ ID NO: 37776 - RNA, 18 nt, Homo sapiens
uacuuugauggaaacaug

SEQ ID NO: 37777 - RNA, 19 nt, Homo sapiens
cucuugaccaguaguguca

SEQ ID NO: 37778 - RNA, 15 nt, Homo sapiens
gaacugagagcauga

SEQ ID NO: 37779 - RNA, 18 nt, Homo sapiens
uagccaaaggcccaaggg

SEQ ID NO: 37780 - RNA, 19 nt, Homo sapiens
uuccagaggcuccccccag

SEQ ID NO: 37781 - RNA, 18 nt, Homo sapiens
uucuccugccucagccuu

SEQ ID NO: 37782 - RNA, 21 nt, Homo sapiens
acagaaaauuuugucucagua

SEQ ID NO: 37783 - RNA, 18 nt, Homo sapiens
auuguaaauaccaugaug

SEQ ID NO: 37784 - RNA, 20 nt, Homo sapiens
ggugcugcugucugcagcaa

SEQ ID NO: 37785 - RNA, 20 nt, Homo sapiens
uucuguguguguuuuuuuag

SEQ ID NO: 37786 - RNA, 25 nt, Homo sapiens
ccaggugcuuucucauuacucuuca

SEQ ID NO: 37787 - RNA, 19 nt, Homo sapiens
agacugacagcagaucucu

SEQ ID NO: 37788 - RNA, 17 nt, Homo sapiens
ucaagugauucuccugc

SEQ ID NO: 37789 - RNA, 18 nt, Homo sapiens
ugucugugaggagcaaga

SEQ ID NO: 37790 - RNA, 25 nt, Homo sapiens
accagggggcggcgcagcucccaca

SEQ ID NO: 37791 - RNA, 18 nt, Homo sapiens
gccagggagcccaggcuc

SEQ ID NO: 37792 - RNA, 20 nt, Homo sapiens
ggacuucaacgagcauuaca

SEQ ID NO: 37793 - RNA, 19 nt, Homo sapiens
gggaugcuggugauuucca

SEQ ID NO: 37794 - RNA, 21 nt, Homo sapiens
gcgggccagggaccuuucguc

SEQ ID NO: 37795 - RNA, 20 nt, Homo sapiens
aggagcagaugaaaugucau

SEQ ID NO: 37796 - RNA, 18 nt, Homo sapiens
cggcuaguggacugaguu

SEQ ID NO: 37797 - RNA, 17 nt, Homo sapiens
gccacaccucagccucc

SEQ ID NO: 37798 - RNA, 22 nt, Homo sapiens
gccuuagcaacacugcucacca

SEQ ID NO: 37799 - RNA, 24 nt, Homo sapiens
aagaagacauuucagugugagauu

SEQ ID NO: 37800 - RNA, 18 nt, Homo sapiens
aaggccacgccggcagcu

SEQ ID NO: 37801 - RNA, 25 nt, Homo sapiens
acccacgccgcaccucauccgugca

SEQ ID NO: 37802 - RNA, 22 nt, Homo sapiens
auguggaugccacaugcugcug

SEQ ID NO: 37803 - RNA, 17 nt, Homo sapiens
cacauguacgcaccaca

SEQ ID NO: 37804 - RNA, 18 nt, Homo sapiens
cccgucaccucguccuca

SEQ ID NO: 37805 - RNA, 22 nt, Homo sapiens
cugcccugagguccuugugugg

SEQ ID NO: 37806 - RNA, 22 nt, Homo sapiens
cugggaugaagagucccccucc

SEQ ID NO: 37807 - RNA, 21 nt, Homo sapiens
cuuguguggccgcccuggcuu

SEQ ID NO: 37808 - RNA, 20 nt, Homo sapiens
ugcacacacauauacacaca

SEQ ID NO: 37809 - RNA, 21 nt, Homo sapiens
acaaugugggacgcugcaaua

SEQ ID NO: 37810 - RNA, 18 nt, Homo sapiens
uggccuauuuagauuccu

SEQ ID NO: 37811 - RNA, 22 nt, Homo sapiens
aacuaacugaugcagccacuga

SEQ ID NO: 37812 - RNA, 19 nt, Homo sapiens
agagaauaaauuugucaua

SEQ ID NO: 37813 - RNA, 19 nt, Homo sapiens
agaaggcuaaaggagcuca

SEQ ID NO: 37814 - RNA, 21 nt, Homo sapiens
aucuugugaugccaccaucgc

SEQ ID NO: 37815 - RNA, 20 nt, Homo sapiens
auugugaauaaaauuuuucu

SEQ ID NO: 37816 - RNA, 18 nt, Homo sapiens
cccacaacccccaccucc

SEQ ID NO: 37817 - RNA, 22 nt, Homo sapiens
ccuucccccaaacuuaucucca

SEQ ID NO: 37818 - RNA, 21 nt, Homo sapiens
cuauuucuuuuacacacauac

SEQ ID NO: 37819 - RNA, 16 nt, Homo sapiens
cuuuggaguguuuaua

SEQ ID NO: 37820 - RNA, 19 nt, Homo sapiens
ucuacguuugguucaauua

SEQ ID NO: 37821 - RNA, 22 nt, Homo sapiens
ugucucucccaacuguuaaguu

SEQ ID NO: 37822 - RNA, 16 nt, Homo sapiens
uguugguccugcuggu

SEQ ID NO: 37823 - RNA, 24 nt, Homo sapiens
uuucuuuuacacacauaccaagga

SEQ ID NO: 37824 - RNA, 22 nt, Homo sapiens
uuugagacggaauuucacuuca

SEQ ID NO: 37825 - RNA, 18 nt, Homo sapiens
aacauagcuucuguugac

SEQ ID NO: 37826 - RNA, 18 nt, Homo sapiens
agcccaucugcuguauua

SEQ ID NO: 37827 - RNA, 24 nt, Homo sapiens
caaauaaugaagaucucuccuuca

SEQ ID NO: 37828 - RNA, 20 nt, Homo sapiens
cucuccuucagucugcucug

SEQ ID NO: 37829 - RNA, 22 nt, Homo sapiens
uaaauggacuucaugaggaaau

SEQ ID NO: 37830 - RNA, 22 nt, Homo sapiens
uccaaaacccggacaagcucuu

SEQ ID NO: 37831 - RNA, 20 nt, Homo sapiens
aaaugcuuuauuaccuuucu

SEQ ID NO: 37832 - RNA, 26 nt, Homo sapiens
aacacaauacuuaauguauuguacua

SEQ ID NO: 37833 - RNA, 19 nt, Homo sapiens
aguguuccuaagauaucuc

SEQ ID NO: 37834 - RNA, 20 nt, Homo sapiens
auacaggcaaacaaccuggu

SEQ ID NO: 37835 - RNA, 22 nt, Homo sapiens
uaccccauaggcaguguaccca

SEQ ID NO: 37836 - RNA, 22 nt, Homo sapiens
uuuuguauauuuuuguuucauc

SEQ ID NO: 37837 - RNA, 18 nt, Homo sapiens
gcaugaugacaaugacca

SEQ ID NO: 37838 - RNA, 22 nt, Homo sapiens
ucuuuagggcacaauaaaggcu

SEQ ID NO: 37839 - RNA, 19 nt, Homo sapiens
aaguaauuuaccaguucua

SEQ ID NO: 37840 - RNA, 19 nt, Homo sapiens
aaguaauuuaccaguucua

SEQ ID NO: 37841 - RNA, 16 nt, Homo sapiens
acccuagggguucugg

SEQ ID NO: 37842 - RNA, 17 nt, Homo sapiens
accuaugccacaucaca

SEQ ID NO: 37843 - RNA, 19 nt, Homo sapiens
agaccuaugccacaucaca

SEQ ID NO: 37844 - RNA, 21 nt, Homo sapiens
cacgacaccccucuucccuca

SEQ ID NO: 37845 - RNA, 18 nt, Homo sapiens
ccaggcacgccaccugcu

SEQ ID NO: 37846 - RNA, 20 nt, Homo sapiens
cuucucuuucucugaccccu

SEQ ID NO: 37847 - RNA, 19 nt, Homo sapiens
ggauaagaaccucacuucc

SEQ ID NO: 37848 - RNA, 19 nt, Homo sapiens
gggauaaaaagucaccucc

SEQ ID NO: 37849 - RNA, 18 nt, Homo sapiens
gguggccuggggcauguc

SEQ ID NO: 37850 - RNA, 18 nt, Homo sapiens
uggcuccaaucuguggac

SEQ ID NO: 37851 - RNA, 21 nt, Homo sapiens
agccucugaucuucccuugaa

SEQ ID NO: 37852 - RNA, 16 nt, Homo sapiens
agggacccagauucuu

SEQ ID NO: 37853 - RNA, 22 nt, Homo sapiens
aguccauccccuccgcccuuca

SEQ ID NO: 37854 - RNA, 21 nt, Homo sapiens
aucuuggcuuacugcaaccuc

SEQ ID NO: 37855 - RNA, 18 nt, Homo sapiens
ccagauucuuuuuuaucc

SEQ ID NO: 37856 - RNA, 19 nt, Homo sapiens
cugcaaccuccgccuccca

SEQ ID NO: 37857 - RNA, 20 nt, Homo sapiens
gcagguagccgacuuugcca

SEQ ID NO: 37858 - RNA, 22 nt, Homo sapiens
gcggaggagaggcugagccuuc

SEQ ID NO: 37859 - RNA, 18 nt, Homo sapiens
uccgccucccagguucaa

SEQ ID NO: 37860 - RNA, 20 nt, Homo sapiens
acaaagggcuaauagccaga

SEQ ID NO: 37861 - RNA, 26 nt, Homo sapiens
gaccgaccagcccaagaaacaucuca

SEQ ID NO: 37862 - RNA, 17 nt, Homo sapiens
gccagugccuugcucuu

SEQ ID NO: 37863 - RNA, 20 nt, Homo sapiens
aagagagggucgcagaccug

SEQ ID NO: 37864 - RNA, 21 nt, Homo sapiens
cuguguuucugccuuguuuua

SEQ ID NO: 37865 - RNA, 21 nt, Homo sapiens
gcaagagcucaugggccauga

SEQ ID NO: 37866 - RNA, 16 nt, Homo sapiens
guccuuuaaaagcauu

SEQ ID NO: 37867 - RNA, 20 nt, Homo sapiens
agaacauggaaagaaaauuu

SEQ ID NO: 37868 - RNA, 19 nt, Homo sapiens
gaccuuguuagugacaugu

SEQ ID NO: 37869 - RNA, 18 nt, Homo sapiens
gugcuuugaggcuucuuc

SEQ ID NO: 37870 - RNA, 19 nt, Homo sapiens
ugagagauuauucguuaua

SEQ ID NO: 37871 - RNA, 20 nt, Homo sapiens
acuaccuccaggagauggaa

SEQ ID NO: 37872 - RNA, 19 nt, Homo sapiens
cagcacugcucugccaagc

SEQ ID NO: 37873 - RNA, 28 nt, Homo sapiens
gaugagaaauuuuucaccacuggacaaa

SEQ ID NO: 37874 - RNA, 21 nt, Homo sapiens
ggaugcccccagaugagauug

SEQ ID NO: 37875 - RNA, 19 nt, Homo sapiens
gugccugucuccuacuuca

SEQ ID NO: 37876 - RNA, 22 nt, Homo sapiens
aaaagagacuuaaugguaugau

SEQ ID NO: 37877 - RNA, 19 nt, Homo sapiens
gcaggauuggggguuucgg

SEQ ID NO: 37878 - RNA, 21 nt, Homo sapiens
uguguaacaguuuuugggaua

SEQ ID NO: 37879 - RNA, 20 nt, Homo sapiens
aaguaauugccaugaacaca

SEQ ID NO: 37880 - RNA, 19 nt, Homo sapiens
agaauacaaguaauugcca

SEQ ID NO: 37881 - RNA, 19 nt, Homo sapiens
cagcacuccagccugggca

SEQ ID NO: 37882 - RNA, 18 nt, Homo sapiens
ccggcaugcccaaccuca

SEQ ID NO: 37883 - RNA, 21 nt, Homo sapiens
ggaugccaguggcccucgcga

SEQ ID NO: 37884 - RNA, 19 nt, Homo sapiens
ucaccuaagcugcacuuca

SEQ ID NO: 37885 - RNA, 18 nt, Homo sapiens
ucccaugucaugcugcca

SEQ ID NO: 37886 - RNA, 19 nt, Homo sapiens
aggacuuuuauaucuauca

SEQ ID NO: 37887 - RNA, 18 nt, Homo sapiens
cauagcaccaaacuccuu

SEQ ID NO: 37888 - RNA, 21 nt, Homo sapiens
uucagcaucaccaagaugaca

SEQ ID NO: 37889 - RNA, 20 nt, Homo sapiens
cgccagaguccuccuccucc

SEQ ID NO: 37890 - RNA, 19 nt, Homo sapiens
gcgcgccggccggccgcug

SEQ ID NO: 37891 - RNA, 18 nt, Homo sapiens
aucuuggccaugaaacug

SEQ ID NO: 37892 - RNA, 21 nt, Homo sapiens
cuggucuagcccagguugcca

SEQ ID NO: 37893 - RNA, 20 nt, Homo sapiens
gacccaggggccccggccuc

SEQ ID NO: 37894 - RNA, 19 nt, Homo sapiens
gagaucacccuugcaguga

SEQ ID NO: 37895 - RNA, 22 nt, Homo sapiens
ucaaggaucuugaugccaagug

SEQ ID NO: 37896 - RNA, 18 nt, Homo sapiens
ucauuugacuccagccaa

SEQ ID NO: 37897 - RNA, 19 nt, Homo sapiens
cugggguccacccuugcca

SEQ ID NO: 37898 - RNA, 20 nt, Homo sapiens
gaggauguuucaaugaugcu

SEQ ID NO: 37899 - RNA, 19 nt, Homo sapiens
gucuugauuagauccaguu

SEQ ID NO: 37900 - RNA, 23 nt, Homo sapiens
uccaguugaaugcuggccaguga

SEQ ID NO: 37901 - RNA, 23 nt, Homo sapiens
ugcagguucucucucauucucua

SEQ ID NO: 37902 - RNA, 18 nt, Homo sapiens
gugugugugagugugagc

SEQ ID NO: 37903 - RNA, 20 nt, Homo sapiens
aauugccucugggugugugu

SEQ ID NO: 37904 - RNA, 18 nt, Homo sapiens
agacuggauaaagccaca

SEQ ID NO: 37905 - RNA, 22 nt, Homo sapiens
aggguuccuucagcccaacaua

SEQ ID NO: 37906 - RNA, 22 nt, Homo sapiens
aggguuccuucagcccaacaua

SEQ ID NO: 37907 - RNA, 22 nt, Homo sapiens
cucugauggugagacuugagga

SEQ ID NO: 37908 - RNA, 16 nt, Homo sapiens
cugaaaagacugugga

SEQ ID NO: 37909 - RNA, 17 nt, Homo sapiens
cuucuuucaucacauca

SEQ ID NO: 37910 - RNA, 23 nt, Homo sapiens
gaggaagaguacucuuuggcuug

SEQ ID NO: 37911 - RNA, 19 nt, Homo sapiens
gaggagggggcauaaagac

SEQ ID NO: 37912 - RNA, 19 nt, Homo sapiens
gucauaaaaaaaaagcuuu

SEQ ID NO: 37913 - RNA, 18 nt, Homo sapiens
gugaugaccauauccagu

SEQ ID NO: 37914 - RNA, 22 nt, Homo sapiens
guguccggaauugguggguucu

SEQ ID NO: 37915 - RNA, 19 nt, Homo sapiens
ucugaugguaagccuggag

SEQ ID NO: 37916 - RNA, 27 nt, Homo sapiens
uuaugucacagaagaaaaaacaaauaa

SEQ ID NO: 37917 - RNA, 18 nt, Homo sapiens
acacuuuuagcucaguua

SEQ ID NO: 37918 - RNA, 18 nt, Homo sapiens
uggguggaucaccugagg

SEQ ID NO: 37919 - RNA, 19 nt, Homo sapiens
uuuugggaagcgagguguc

SEQ ID NO: 37920 - RNA, 17 nt, Homo sapiens
gaagaaagaugaaucua

SEQ ID NO: 37921 - RNA, 18 nt, Homo sapiens
ugcugcauugcuccagca

SEQ ID NO: 37922 - RNA, 18 nt, Homo sapiens
caaagcugcagcaugcac

SEQ ID NO: 37923 - RNA, 17 nt, Homo sapiens
cgcccaccuccacccca

SEQ ID NO: 37924 - RNA, 20 nt, Homo sapiens
uguaccccacgcccaccucc

SEQ ID NO: 37925 - RNA, 18 nt, Homo sapiens
aacaccgcucaggccuga

SEQ ID NO: 37926 - RNA, 18 nt, Homo sapiens
accaccaucaccuccucc

SEQ ID NO: 37927 - RNA, 18 nt, Homo sapiens
acccuggcucccaaggcu

SEQ ID NO: 37928 - RNA, 22 nt, Homo sapiens
agccaaggugcugguguugcca

SEQ ID NO: 37929 - RNA, 25 nt, Homo sapiens
aucugagcagggaucgaucuggccu

SEQ ID NO: 37930 - RNA, 25 nt, Homo sapiens
cagcacuugcauggcacuucccucu

SEQ ID NO: 37931 - RNA, 17 nt, Homo sapiens
cagcuggauccugcugc

SEQ ID NO: 37932 - RNA, 19 nt, Homo sapiens
cagcuggugcugacccaca

SEQ ID NO: 37933 - RNA, 21 nt, Homo sapiens
cccagacauggccuucugccu

SEQ ID NO: 37934 - RNA, 21 nt, Homo sapiens
cuauugugggaccuugugauu

SEQ ID NO: 37935 - RNA, 18 nt, Homo sapiens
gaccuggccgccuccauc

SEQ ID NO: 37936 - RNA, 22 nt, Homo sapiens
gcuucucugggucccacucucu

SEQ ID NO: 37937 - RNA, 30 nt, Homo sapiens; identical to SEQ ID NO: 37245

SEQ ID NO: 37938 - RNA, 21 nt, Homo sapiens
ugaagaguuuucugccaauga

SEQ ID NO: 37939 - RNA, 24 nt, Homo sapiens
uggauaucccuccagguggggcug

SEQ ID NO: 37940 - RNA, 20 nt, Homo sapiens
ugucuguggagcuagcugag

SEQ ID NO: 37941 - RNA, 25 nt, Homo sapiens
uuaauacugagugucaacuugauug

SEQ ID NO: 37942 - RNA, 21 nt, Homo sapiens
uuccagugcgccccacuguca

SEQ ID NO: 37943 - RNA, 20 nt, Homo sapiens
aagacaccugucaaauguca

SEQ ID NO: 37944 - RNA, 16 nt, Homo sapiens
acaucacagggcaagc

SEQ ID NO: 37945 - RNA, 22 nt, Homo sapiens
acucgccucugcuccugugguc

SEQ ID NO: 37946 - RNA, 18 nt, Homo sapiens
cacucuccagccauuugg

SEQ ID NO: 37947 - RNA, 19 nt, Homo sapiens
ccagcuccacacacccccc

SEQ ID NO: 37948 - RNA, 17 nt, Homo sapiens
cccccugggauggcuca

SEQ ID NO: 37949 - RNA, 18 nt, Homo sapiens
ccgggugggggauuuugg

SEQ ID NO: 37950 - RNA, 24 nt, Homo sapiens
gcaggcaucaaacuuuacauccca

SEQ ID NO: 37951 - RNA, 17 nt, Homo sapiens
ugccaccaccaagccca

SEQ ID NO: 37952 - RNA, 20 nt, Homo sapiens
aagacaccugucaaauguca

SEQ ID NO: 37953 - RNA, 16 nt, Homo sapiens
acaucacagggcaagc

SEQ ID NO: 37954 - RNA, 22 nt, Homo sapiens
acucgccucugcuccugugguc

SEQ ID NO: 37955 - RNA, 18 nt, Homo sapiens
cacucuccagccauuugg

SEQ ID NO: 37956 - RNA, 19 nt, Homo sapiens
ccagcuccacacacccccc

SEQ ID NO: 37957 - RNA, 17 nt, Homo sapiens
cccccugggauggcuca

SEQ ID NO: 37958 - RNA, 18 nt, Homo sapiens
ccgggugggggauuuugg

SEQ ID NO: 37959 - RNA, 24 nt, Homo sapiens
gcaggcaucaaacuuuacauccca

SEQ ID NO: 37960 - RNA, 17 nt, Homo sapiens
ugccaccaccaagccca

SEQ ID NO: 37961 - RNA, 22 nt, Homo sapiens
cugucuccuguucaucauccca

SEQ ID NO: 37962 - RNA, 17 nt, Homo sapiens
guuccaucauccucuga

SEQ ID NO: 37963 - RNA, 18 nt, Homo sapiens
uaauuuugcauuagucuc

SEQ ID NO: 37964 - RNA, 21 nt, Homo sapiens
ucaaguuauuucuccuucucu

SEQ ID NO: 37965 - RNA, 20 nt, Homo sapiens
uucccaaaaucucaauuuca

SEQ ID NO: 37966 - RNA, 20 nt, Homo sapiens
uugcuacaguauuuacuguu

SEQ ID NO: 37967 - RNA, 18 nt, Homo sapiens
aaguuguugcuuuggaau

SEQ ID NO: 37968 - RNA, 19 nt, Homo sapiens
acuucaucaaacuucaaca

SEQ ID NO: 37969 - RNA, 21 nt, Homo sapiens
agcugcucccggguugccaga

SEQ ID NO: 37970 - RNA, 21 nt, Homo sapiens
cagccccucccaguccccuca

SEQ ID NO: 37971 - RNA, 19 nt, Homo sapiens
cauuuuaaccacaacuuca

SEQ ID NO: 37972 - RNA, 25 nt, Homo sapiens
cccaggugcaaaaccccacauccca

SEQ ID NO: 37973 - RNA, 20 nt, Homo sapiens
ccucugccucccagguucaa

SEQ ID NO: 37974 - RNA, 17 nt, Homo sapiens
ucaagugauucuccugc

SEQ ID NO: 37975 - RNA, 26 nt, Homo sapiens
uaaauguugauuuuaauauggagcua

SEQ ID NO: 37976 - RNA, 19 nt, Homo sapiens
agauuuucuugaauggcag

SEQ ID NO: 37977 - RNA, 17 nt, Homo sapiens
auugaaugcagcauuac

SEQ ID NO: 37978 - RNA, 21 nt, Homo sapiens
gaaaaggugggaaauauuuuc

SEQ ID NO: 37979 - RNA, 20 nt, Homo sapiens
gaauauaaaacaguuuauga

SEQ ID NO: 37980 - RNA, 19 nt, Homo sapiens
ugacuacugcaugcaugug

SEQ ID NO: 37981 - RNA, 17 nt, Homo sapiens
acaagaagcaugggcac

SEQ ID NO: 37982 - RNA, 19 nt, Homo sapiens
cuucucgugucaccaagga

SEQ ID NO: 37983 - RNA, 19 nt, Homo sapiens
ggcuauuacuguuuaccca

SEQ ID NO: 37984 - RNA, 20 nt, Homo sapiens
ucgcugcauucaggauuguu

SEQ ID NO: 37985 - RNA, 21 nt, Homo sapiens
ugaaaggcuuuuaucuucuuc

SEQ ID NO: 37986 - RNA, 18 nt, Homo sapiens
gaaacuccgaacacaugc

SEQ ID NO: 37987 - RNA, 19 nt, Homo sapiens
aucaggauaguagaucuau

SEQ ID NO: 37988 - RNA, 19 nt, Homo sapiens
auggauacagagaaaugua

SEQ ID NO: 37989 - RNA, 19 nt, Homo sapiens
auucggaacuuucaacaaa

SEQ ID NO: 37990 - RNA, 21 nt, Homo sapiens
auuuggguuguuuccagguuu

SEQ ID NO: 37991 - RNA, 23 nt, Homo sapiens
guauauaaauaaaaucauucgac

SEQ ID NO: 37992 - RNA, 18 nt, Homo sapiens
uaucuaucuaucccauca

SEQ ID NO: 37993 - RNA, 20 nt, Homo sapiens
ugcuguuaagugucuucuga

SEQ ID NO: 37994 - RNA, 24 nt, Homo sapiens
uuugaacuuucuccccacuccuca

SEQ ID NO: 37995 - RNA, 19 nt, Homo sapiens
accaugugaauaauagaga

SEQ ID NO: 37996 - RNA, 22 nt, Homo sapiens
agcuggguauuguaaaaucuca

SEQ ID NO: 37997 - RNA, 18 nt, Homo sapiens
cuuugacuggaagaguca

SEQ ID NO: 37998 - RNA, 21 nt, Homo sapiens
uaucagugaacccccauguuu

SEQ ID NO: 37999 - RNA, 18 nt, Homo sapiens
accucuucuuucugugac

SEQ ID NO: 38000 - RNA, 18 nt, Homo sapiens
gagguuaaguuuacuuca

SEQ ID NO: 38001 - RNA, 23 nt, Homo sapiens
guuuauugggggggcuuuuuuua

SEQ ID NO: 38002 - RNA, 21 nt, Homo sapiens
uaaaggauuuuaacaagaccc

SEQ ID NO: 38003 - RNA, 22 nt, Homo sapiens
ugauuccaggcugggcucgguu

SEQ ID NO: 38004 - RNA, 23 nt, Homo sapiens
acaaagcauauuaaauggcaaua

SEQ ID NO: 38005 - RNA, 21 nt, Homo sapiens
aucccaccucaucccauuuuu

SEQ ID NO: 38006 - RNA, 19 nt, Homo sapiens
cauaauacaaagcauauua

SEQ ID NO: 38007 - RNA, 16 nt, Homo sapiens
cucuuugaucauggcg

SEQ ID NO: 38008 - RNA, 21 nt, Homo sapiens
cuugaacauucuaaauuacuu

SEQ ID NO: 38009 - RNA, 17 nt, Homo sapiens
uuccaaauuuuaagcug

SEQ ID NO: 38010 - RNA, 20 nt, Homo sapiens
aaaguugccugcucuggcag

SEQ ID NO: 38011 - RNA, 15 nt, Homo sapiens
aggaaaagaaagcaa

SEQ ID NO: 38012 - RNA, 19 nt, Homo sapiens
cagcaggagccaagaggaa

SEQ ID NO: 38013 - RNA, 18 nt, Homo sapiens
ggagcuuuuuaaauuuca

SEQ ID NO: 38014 - RNA, 19 nt, Homo sapiens
ucugucuuccucuuccuac

SEQ ID NO: 38015 - RNA, 17 nt, Homo sapiens
caagauuggcucaguca

SEQ ID NO: 38016 - RNA, 17 nt, Homo sapiens
aguggucaacaaugaca

SEQ ID NO: 38017 - RNA, 20 nt, Homo sapiens
uggggucaacacaugugaug

SEQ ID NO: 38018 - RNA, 19 nt, Homo sapiens
aauaauugccuauauccuu

SEQ ID NO: 38019 - RNA, 19 nt, Homo sapiens
agcgccuccaguacgucuu

SEQ ID NO: 38020 - RNA, 22 nt, Homo sapiens
aucuuggcucagugcaaucucu

SEQ ID NO: 38021 - RNA, 22 nt, Homo sapiens
cagagguaacaaaagucugugg

SEQ ID NO: 38022 - RNA, 20 nt, Homo sapiens
cuuauaccuguugcuuacua

SEQ ID NO: 38023 - RNA, 23 nt, Homo sapiens
ggcaugagccaccucgcccagcc

SEQ ID NO: 38024 - RNA, 22 nt, Homo sapiens
guagcuuuaggauguguuugca

SEQ ID NO: 38025 - RNA, 18 nt, Homo sapiens
gucccauuguguuccucc

SEQ ID NO: 38026 - RNA, 19 nt, Homo sapiens
guuuugccauagaguguga

SEQ ID NO: 38027 - RNA, 21 nt, Homo sapiens
uccauuugcaaauaccauacu

SEQ ID NO: 38028 - RNA, 21 nt, Homo sapiens
ucuggguugagauccuggccc

SEQ ID NO: 38029 - RNA, 18 nt, Homo sapiens
uuauaaaacaauagcgua

SEQ ID NO: 38030 - RNA, 21 nt, Homo sapiens
uuguaaauauguuuucugccu

SEQ ID NO: 38031 - RNA, 20 nt, Homo sapiens
ccaccucccaccuccacccc

SEQ ID NO: 38032 - RNA, 18 nt, Homo sapiens
gaaaaaaaucugaagcca

SEQ ID NO: 38033 - RNA, 24 nt, Homo sapiens
ggauuuggucaaauagacugagaa

SEQ ID NO: 38034 - RNA, 16 nt, Homo sapiens
aauuagcugcagccaa

SEQ ID NO: 38035 - RNA, 18 nt, Homo sapiens
caaguccuccuccgccuc

SEQ ID NO: 38036 - RNA, 21 nt, Homo sapiens
ccaccccacaauggcagaaga

SEQ ID NO: 38037 - RNA, 21 nt, Homo sapiens
cugcagcaguugcacucuuuu

SEQ ID NO: 38038 - RNA, 22 nt, Homo sapiens
gagccaagaucacgccacugca

SEQ ID NO: 38039 - RNA, 21 nt, Homo sapiens
gccuuuccuccauuuucugug

SEQ ID NO: 38040 - RNA, 20 nt, Homo sapiens
gcucgcugggauuuggcuga

SEQ ID NO: 38041 - RNA, 17 nt, Homo sapiens
ggagcuuucuaaaucuc

SEQ ID NO: 38042 - RNA, 25 nt, Homo sapiens
ucucccccaaguccuccuccgccuc

SEQ ID NO: 38043 - RNA, 21 nt, Homo sapiens
uggauggacuguuggguacug

SEQ ID NO: 38044 - RNA, 19 nt, Homo sapiens
uuuuucuuuuuucauuuca

SEQ ID NO: 38045 - RNA, 18 nt, Homo sapiens
aagaaaguaacaugauca

SEQ ID NO: 38046 - RNA, 21 nt, Homo sapiens
ccugaagagucauugaucaga

SEQ ID NO: 38047 - RNA, 19 nt, Homo sapiens
ccuuguguuugcugccaaa

SEQ ID NO: 38048 - RNA, 19 nt, Homo sapiens
guacccucccuggaguuca

SEQ ID NO: 38049 - RNA, 21 nt, Homo sapiens
uggaacuccagccuggagcug

SEQ ID NO: 38050 - RNA, 24 nt, Homo sapiens
agcaaccacaucaggaucggaauc

SEQ ID NO: 38051 - RNA, 19 nt, Homo sapiens
aguggccacauuuaagaaa

SEQ ID NO: 38052 - RNA, 24 nt, Homo sapiens
aucuugggagucuacauuuucuua

SEQ ID NO: 38053 - RNA, 20 nt, Homo sapiens
agucucacucugucguccag

SEQ ID NO: 38054 - RNA, 18 nt, Homo sapiens
cuuauacugaagugugaa

SEQ ID NO: 38055 - RNA, 23 nt, Homo sapiens
gcagaaacaaugaaaaccuuaua

SEQ ID NO: 38056 - RNA, 17 nt, Homo sapiens
ucaagugauucuccugc

SEQ ID NO: 38057 - RNA, 18 nt, Homo sapiens
ucugaauuucgucugucu

SEQ ID NO: 38058 - RNA, 23 nt, Homo sapiens
ggggacgaggcggcggcggcggc

SEQ ID NO: 38059 - RNA, 21 nt, Homo sapiens
accugggccgugauugggcgc

SEQ ID NO: 38060 - RNA, 26 nt, Homo sapiens
acuuggagagcaagcuguuugagucu

SEQ ID NO: 38061 - RNA, 21 nt, Homo sapiens
caccaugcccagccuccuucu

SEQ ID NO: 38062 - RNA, 19 nt, Homo sapiens
ccugcuagcaagguuccca

SEQ ID NO: 38063 - RNA, 22 nt, Homo sapiens
uaagugggccugcuugaaguug

SEQ ID NO: 38064 - RNA, 22 nt, Homo sapiens
ucccucucauccaugcauucua

SEQ ID NO: 38065 - RNA, 18 nt, Homo sapiens
aucccuggagccuccaga

SEQ ID NO: 38066 - RNA, 18 nt, Homo sapiens
gcgcgcccgcccgccccc

SEQ ID NO: 38067 - RNA, 25 nt, Homo sapiens
gggcccccccgcaucgcgccgccca

SEQ ID NO: 38068 - RNA, 21 nt, Homo sapiens
ggucagccgccccaccugaca

SEQ ID NO: 38069 - RNA, 17 nt, Homo sapiens
uggagaagcugggcagg

SEQ ID NO: 38070 - RNA, 18 nt, Homo sapiens
uggccugccgcaccccca

SEQ ID NO: 38071 - RNA, 23 nt, Homo sapiens
gcccgcccgcaccaacccucuga

SEQ ID NO: 38072 - RNA, 22 nt, Homo sapiens
gugccuugguuuccuggccucu

SEQ ID NO: 38073 - RNA, 21 nt, Homo sapiens
ucagcacauagcaagugcuca

SEQ ID NO: 38074 - RNA, 19 nt, Homo sapiens
ucugacucccuccaccuca

SEQ ID NO: 38075 - RNA, 27 nt, Homo sapiens
guaaaagcuccucuguuccuuguaaua

SEQ ID NO: 38076 - RNA, 19 nt, Homo sapiens
cugucugcaacaucccuca

SEQ ID NO: 38077 - RNA, 19 nt, Homo sapiens
uuuuaugcaaaguaggcag

SEQ ID NO: 38078 - RNA, 17 nt, Homo sapiens
ucuggcuaggcucggcg

SEQ ID NO: 38079 - RNA, 17 nt, Homo sapiens
cugggucuggccuggcc

SEQ ID NO: 38080 - RNA, 21 nt, Homo sapiens
acucugccucccucccaccuc

SEQ ID NO: 38081 - RNA, 17 nt, Homo sapiens
aucaccaccgccggcgu

SEQ ID NO: 38082 - RNA, 22 nt, Homo sapiens
caaucuugaauuuuauuuucug

SEQ ID NO: 38083 - RNA, 17 nt, Homo sapiens
caccaccaucaucacca

SEQ ID NO: 38084 - RNA, 19 nt, Homo sapiens
caccaccaucaucaccacc

SEQ ID NO: 38085 - RNA, 22 nt, Homo sapiens
caccaccaucaucaccaccgcc

SEQ ID NO: 38086 - RNA, 20 nt, Homo sapiens
caccaucaucaccaccgccg

SEQ ID NO: 38087 - RNA, 20 nt, Homo sapiens
cauuucuguuccuccaauga

SEQ ID NO: 38088 - RNA, 21 nt, Homo sapiens
cuccccauaaauaccaccuug

SEQ ID NO: 38089 - RNA, 17 nt, Homo sapiens
gcagguaacagagguga

SEQ ID NO: 38090 - RNA, 25 nt, Homo sapiens
aagaggagaauuuucccguuaauuu

SEQ ID NO: 38091 - RNA, 18 nt, Homo sapiens
aauuuucccagcccuaaa

SEQ ID NO: 38092 - RNA, 22 nt, Homo sapiens
acauuuaaugggcaccuauggg

SEQ ID NO: 38093 - RNA, 21 nt, Homo sapiens
agugguagucccagcuacuca

SEQ ID NO: 38094 - RNA, 19 nt, Homo sapiens
auuagucucuccucuguga

SEQ ID NO: 38095 - RNA, 19 nt, Homo sapiens
caccauggaaaccaguucc

SEQ ID NO: 38096 - RNA, 20 nt, Homo sapiens
ccauuaaaaaaauuaacuug

SEQ ID NO: 38097 - RNA, 20 nt, Homo sapiens
gcaagacacacacacaucaa

SEQ ID NO: 38098 - RNA, 18 nt, Homo sapiens
gccauaaauuuugccuug

SEQ ID NO: 38099 - RNA, 21 nt, Homo sapiens
aucuuacugguuguuaggccu

SEQ ID NO: 38100 - RNA, 21 nt, Homo sapiens
gccccgagcaggcccaccuuu

SEQ ID NO: 38101 - RNA, 21 nt, Homo sapiens
gccugaauaggcuccuggccc

SEQ ID NO: 38102 - RNA, 24 nt, Homo sapiens
gccugaauugcaguuccugugccc

SEQ ID NO: 38103 - RNA, 19 nt, Homo sapiens
aaacuccugaccucaggug

SEQ ID NO: 38104 - RNA, 21 nt, Homo sapiens
aggcacccaccaucccaucca

SEQ ID NO: 38105 - RNA, 19 nt, Homo sapiens
aggcgcccaccuccacacc

SEQ ID NO: 38106 - RNA, 18 nt, Homo sapiens
agguguguauaucucuca

SEQ ID NO: 38107 - RNA, 16 nt, Homo sapiens
aguaagugggugucag

SEQ ID NO: 38108 - RNA, 16 nt, Homo sapiens
cagcuggaugaccuca

SEQ ID NO: 38109 - RNA, 18 nt, Homo sapiens
ccugcaaccuccaccucc

SEQ ID NO: 38110 - RNA, 22 nt, Homo sapiens
gagccaagauggcgccacuaca

SEQ ID NO: 38111 - RNA, 24 nt, Homo sapiens
gccaccuuuuccugggaaccugga

SEQ ID NO: 38112 - RNA, 19 nt, Homo sapiens
ggccagacuguguuuguua

SEQ ID NO: 38113 - RNA, 18 nt, Homo sapiens
guucuuccccuucuggug

SEQ ID NO: 38114 - RNA, 18 nt, Homo sapiens
uagugaaucuguacagua

SEQ ID NO: 38115 - RNA, 23 nt, Homo sapiens
uauucagugaaugccagcucuca

SEQ ID NO: 38116 - RNA, 18 nt, Homo sapiens
uccaccucccggguucaa

SEQ ID NO: 38117 - RNA, 19 nt, Homo sapiens
ucuagaaucauauugucua

SEQ ID NO: 38118 - RNA, 19 nt, Homo sapiens
ugcaaugccauccucgcca

SEQ ID NO: 38119 - RNA, 22 nt, Homo sapiens
cguuuccauccuguuucuguga

SEQ ID NO: 38120 - RNA, 17 nt, Homo sapiens
cccgcccucccccagcu

SEQ ID NO: 38121 - RNA, 24 nt, Homo sapiens
cccugcuucccaccacuucccuca

SEQ ID NO: 38122 - RNA, 18 nt, Homo sapiens
ccugcuucccaccacuuc

SEQ ID NO: 38123 - RNA, 19 nt, Homo sapiens
ccugggcaaucuuaacauc

SEQ ID NO: 38124 - RNA, 16 nt, Homo sapiens
gacccacgccucccgc

SEQ ID NO: 38125 - RNA, 22 nt, Homo sapiens
uccuuaacacccuauucuuccu

SEQ ID NO: 38126 - RNA, 19 nt, Homo sapiens
uugggccuggguggcuuuu

SEQ ID NO: 38127 - RNA, 21 nt, Homo sapiens
cacagguacagguggcugcag

SEQ ID NO: 38128 - RNA, 21 nt, Homo sapiens
cuuacccuuucacacagauca

SEQ ID NO: 38129 - RNA, 21 nt, Homo sapiens
uaaaacacaaaaaauuagcca

SEQ ID NO: 38130 - RNA, 19 nt, Homo sapiens
ucugagccaggccugugag

SEQ ID NO: 38131 - RNA, 19 nt, Homo sapiens
ugcacucaugcaagcuucu

SEQ ID NO: 38132 - RNA, 19 nt, Homo sapiens
accucagaaugcaaccuuc

SEQ ID NO: 38133 - RNA, 23 nt, Homo sapiens
uggccuugaacucuugggcucaa

SEQ ID NO: 38134 - RNA, 21 nt, Homo sapiens
ugggcacugacagugaggcug

SEQ ID NO: 38135 - RNA, 19 nt, Homo sapiens
cuccccaaagccaucuggu

SEQ ID NO: 38136 - RNA, 20 nt, Homo sapiens
cuucugccuccuagguucaa

SEQ ID NO: 38137 - RNA, 18 nt, Homo sapiens
gccuuccaaagugcauua

SEQ ID NO: 38138 - RNA, 17 nt, Homo sapiens
ucuaacugcaccccuuc

SEQ ID NO: 38139 - RNA, 21 nt, Homo sapiens
gguaagugggaaagccuuuug

SEQ ID NO: 38140 - RNA, 18 nt, Homo sapiens
gcaacagcuaggcugcug

SEQ ID NO: 38141 - RNA, 18 nt, Homo sapiens
gggccgagaacuuugcca

SEQ ID NO: 38142 - RNA, 16 nt, Homo sapiens
cuguuuuggagacugc

SEQ ID NO: 38143 - RNA, 24 nt, Homo sapiens
ggaagagacgucgccuccccuuca

SEQ ID NO: 38144 - RNA, 24 nt, Homo sapiens
guuuuggagacugccuauaaguua

SEQ ID NO: 38145 - RNA, 24 nt, Homo sapiens
cccgccuuuuuugcggccaccauu

SEQ ID NO: 38146 - RNA, 20 nt, Homo sapiens
gagguucccccagcugccac

SEQ ID NO: 38147 - RNA, 21 nt, Homo sapiens
cuugcggccaccgccccccgg

SEQ ID NO: 38148 - RNA, 22 nt, Homo sapiens
ccgcucugugacaguccaugac

SEQ ID NO: 38149 - RNA, 20 nt, Homo sapiens
gcacgccaccacccagcuca

SEQ ID NO: 38150 - RNA, 17 nt, Homo sapiens
uuuugggacagagucuc

SEQ ID NO: 38151 - RNA, 20 nt, Homo sapiens
gggagcccggcggcuucggc

SEQ ID NO: 38152 - RNA, 18 nt, Homo sapiens
aaaucacaaaccuugaaa

SEQ ID NO: 38153 - RNA, 25 nt, Homo sapiens
accugagcacgucuugccugagucc

SEQ ID NO: 38154 - RNA, 18 nt, Homo sapiens
aagucaauucuauguagu

SEQ ID NO: 38155 - RNA, 19 nt, Homo sapiens
agcaucaucaacaucacca

SEQ ID NO: 38156 - RNA, 22 nt, Homo sapiens
aucucggcucacugcaaucucu

SEQ ID NO: 38157 - RNA, 21 nt, Homo sapiens
ccgagauggagucuuacucug

SEQ ID NO: 38158 - RNA, 18 nt, Homo sapiens
gcuuugacuauuuggccu

SEQ ID NO: 38159 - RNA, 20 nt, Homo sapiens
ucucugccucucggguucaa

SEQ ID NO: 38160 - RNA, 20 nt, Homo sapiens
uuugcuugcccugcccccga

SEQ ID NO: 38161 - RNA, 23 nt, Homo sapiens
auaaucucaagacuccucccuua

SEQ ID NO: 38162 - RNA, 17 nt, Homo sapiens
aucaaaugaauaugugu

SEQ ID NO: 38163 - RNA, 19 nt, Homo sapiens
caacaacauucuauaacug

SEQ ID NO: 38164 - RNA, 19 nt, Homo sapiens
cucuggugauggcugugag

SEQ ID NO: 38165 - RNA, 17 nt, Homo sapiens
gcugucggcaguacuca

SEQ ID NO: 38166 - RNA, 16 nt, Homo sapiens
aggagccugagcuggc

SEQ ID NO: 38167 - RNA, 22 nt, Homo sapiens
ccaccucggucaccuccaccuc

SEQ ID NO: 38168 - RNA, 16 nt, Homo sapiens
ccuaccacggcuccgg

SEQ ID NO: 38169 - RNA, 19 nt, Homo sapiens
cuaccgucaggaugcuuca

SEQ ID NO: 38170 - RNA, 17 nt, Homo sapiens
cucugggaggaagcugc

SEQ ID NO: 38171 - RNA, 19 nt, Homo sapiens
cugaggcucugguaggcug

SEQ ID NO: 38172 - RNA, 19 nt, Homo sapiens
ugaccaacauccuagagca

SEQ ID NO: 38173 - RNA, 15 nt, Homo sapiens
ugagcagcaacagca

SEQ ID NO: 38174 - RNA, 22 nt, Homo sapiens
agcugggugcacccugacccca

SEQ ID NO: 38175 - RNA, 22 nt, Homo sapiens
aggaaaaucgguuccaaggaca

SEQ ID NO: 38176 - RNA, 22 nt, Homo sapiens
cugagccugucagugggucaga

SEQ ID NO: 38177 - RNA, 18 nt, Homo sapiens
agaaauacuccaugugau

SEQ ID NO: 38178 - RNA, 19 nt, Homo sapiens
ccaucccccacccaccugc

SEQ ID NO: 38179 - RNA, 21 nt, Homo sapiens
ccugugccccacaaggagcug

SEQ ID NO: 38180 - RNA, 23 nt, Homo sapiens
ggcaaugacagauacuaccugcu

SEQ ID NO: 38181 - RNA, 17 nt, Homo sapiens
aucccaaagccauucca

SEQ ID NO: 38182 - RNA, 20 nt, Homo sapiens
gaguaaagauaaccuagucg

SEQ ID NO: 38183 - RNA, 16 nt, Homo sapiens
aacaacaaacaaagaa

SEQ ID NO: 38184 - RNA, 19 nt, Homo sapiens
acauucacugcuaucacca

SEQ ID NO: 38185 - RNA, 24 nt, Homo sapiens
caaggaaaacaaacaacaaauaca

SEQ ID NO: 38186 - RNA, 18 nt, Homo sapiens
ggaggaggagggaugcca

SEQ ID NO: 38187 - RNA, 23 nt, Homo sapiens
ggaggagggaugccacacagaca

SEQ ID NO: 38188 - RNA, 20 nt, Homo sapiens
uacagcugcgaagaaggcag

SEQ ID NO: 38189 - RNA, 20 nt, Homo sapiens
ugcccguuugcccgugccag

SEQ ID NO: 38190 - RNA, 20 nt, Homo sapiens
ugggcuauuucauuccuggu

SEQ ID NO: 38191 - RNA, 17 nt, Homo sapiens
aaucucauuguacuaca

SEQ ID NO: 38192 - RNA, 17 nt, Homo sapiens
ccacugagaagaccgcu

SEQ ID NO: 38193 - RNA, 17 nt, Homo sapiens
cugacucagccucugau

SEQ ID NO: 38194 - RNA, 19 nt, Homo sapiens
gguuuuugaauugcagcag

SEQ ID NO: 38195 - RNA, 17 nt, Homo sapiens
guccuuugagcgcagcu

SEQ ID NO: 38196 - RNA, 25 nt, Homo sapiens
uuuuuguuugguugguuuuggcuuu

SEQ ID NO: 38197 - RNA, 22 nt, Homo sapiens
accuggauuccuagcuuggcuc

SEQ ID NO: 38198 - RNA, 19 nt, Homo sapiens
cagacaucauuacauuuca

SEQ ID NO: 38199 - RNA, 20 nt, Homo sapiens
guaagcugagauggcuccau

SEQ ID NO: 38200 - RNA, 24 nt, Homo sapiens
uacauuucacuucuaaacacuuca

SEQ ID NO: 38201 - RNA, 20 nt, Homo sapiens
ucugccugcccuauccugac

SEQ ID NO: 38202 - RNA, 20 nt, Homo sapiens
acugacauuauuuaguguca

SEQ ID NO: 38203 - RNA, 21 nt, Homo sapiens
aucuuggcucaccacaaccuc

SEQ ID NO: 38204 - RNA, 22 nt, Homo sapiens
cccauggcccaguaugaggcca

SEQ ID NO: 38205 - RNA, 18 nt, Homo sapiens
cuggcugcugcuuggccc

SEQ ID NO: 38206 - RNA, 22 nt, Homo sapiens
gaaaaaaacucucuuccugugu

SEQ ID NO: 38207 - RNA, 16 nt, Homo sapiens
gcgugaaaaccuugcc

SEQ ID NO: 38208 - RNA, 23 nt, Homo sapiens
ggcgugagccaccgcgcccggcc

SEQ ID NO: 38209 - RNA, 20 nt, Homo sapiens
guuuauuuuccaucacugua

SEQ ID NO: 38210 - RNA, 17 nt, Homo sapiens
ucaagugauucuccugc

SEQ ID NO: 38211 - RNA, 20 nt, Homo sapiens
ucaccacaaccuccaccucc

SEQ ID NO: 38212 - RNA, 18 nt, Homo sapiens
uccaccucccagguucaa

SEQ ID NO: 38213 - RNA, 20 nt, Homo sapiens
uggucaggcuggucuugaac

SEQ ID NO: 38214 - RNA, 20 nt, Homo sapiens
aacuagaaucagcaacgaga

SEQ ID NO: 38215 - RNA, 19 nt, Homo sapiens
acauaguggacagcauugu

SEQ ID NO: 38216 - RNA, 21 nt, Homo sapiens
caggaucaugcacccuuguua

SEQ ID NO: 38217 - RNA, 20 nt, Homo sapiens
aaaaauaagcuggguguggu

SEQ ID NO: 38218 - RNA, 20 nt, Homo sapiens
ccaaaagcugcagagucuga

SEQ ID NO: 38219 - RNA, 20 nt, Homo sapiens
gagcuuuuuggaaauacuca

SEQ ID NO: 38220 - RNA, 19 nt, Homo sapiens
ucuuccuccuuauuccuca

SEQ ID NO: 38221 - RNA, 19 nt, Homo sapiens
ugggugacagugugagauu

SEQ ID NO: 38222 - RNA, 23 nt, Homo sapiens
cgagugugagguuagguccagca

SEQ ID NO: 38223 - RNA, 18 nt, Homo sapiens
cuaacugguagcauuugc

SEQ ID NO: 38224 - RNA, 20 nt, Homo sapiens
cugcugaugaaugaccgagu

SEQ ID NO: 38225 - RNA, 20 nt, Homo sapiens
gcuugggcccaggucugucu

SEQ ID NO: 38226 - RNA, 18 nt, Homo sapiens
gggcuugagaagcuccuu

SEQ ID NO: 38227 - RNA, 22 nt, Homo sapiens
acaaaauaauggcauucacagc

SEQ ID NO: 38228 - RNA, 18 nt, Homo sapiens
auacauuggguacagugu

SEQ ID NO: 38229 - RNA, 18 nt, Homo sapiens
gggugcaccaaaaucuca

SEQ ID NO: 38230 - RNA, 23 nt, Homo sapiens
ccacccucucucuaccugucacc

SEQ ID NO: 38231 - RNA, 19 nt, Homo sapiens
cugccaccacccucucucu

SEQ ID NO: 38232 - RNA, 20 nt, Homo sapiens
ugcccuccaauguggggcug

SEQ ID NO: 38233 - RNA, 19 nt, Homo sapiens
cauguaccaggugucccag

SEQ ID NO: 38234 - RNA, 26 nt, Homo sapiens
gccagccaccgugugaacucuuugga

SEQ ID NO: 38235 - RNA, 20 nt, Homo sapiens
ggagccagggccgaguccuc

SEQ ID NO: 38236 - RNA, 23 nt, Homo sapiens
gugccagccaccgugugaacucu

SEQ ID NO: 38237 - RNA, 18 nt, Homo sapiens
ccugcaaccuccaccucc

SEQ ID NO: 38238 - RNA, 19 nt, Homo sapiens
cugcaaccuccaccuccca

SEQ ID NO: 38239 - RNA, 22 nt, Homo sapiens
ucacaccauuuccuguuucuuu

SEQ ID NO: 38240 - RNA, 18 nt, Homo sapiens
uccaccucccagguucaa

SEQ ID NO: 38241 - RNA, 21 nt, Homo sapiens
uucugaccccugugccuccca

SEQ ID NO: 38242 - RNA, 18 nt, Homo sapiens
aguugugaaugaaauguc

SEQ ID NO: 38243 - RNA, 19 nt, Homo sapiens
auggcuuggaccaggccag

SEQ ID NO: 38244 - RNA, 22 nt, Homo sapiens
gccccccucgcccagccugaga

SEQ ID NO: 38245 - RNA, 21 nt, Homo sapiens
agcuggaguuuucuucuguga

SEQ ID NO: 38246 - RNA, 15 nt, Homo sapiens
auggcggaguucuga

SEQ ID NO: 38247 - RNA, 19 nt, Homo sapiens
guggacacuuugaaccacu

SEQ ID NO: 38248 - RNA, 21 nt, Homo sapiens
uggucauccgccguggggcug

SEQ ID NO: 38249 - RNA, 19 nt, Homo sapiens
cacaaaaauacucagcucc

SEQ ID NO: 38250 - RNA, 20 nt, Homo sapiens
ucacguguguucuuugucau

SEQ ID NO: 38251 - RNA, 18 nt, Homo sapiens
gaaauauacuuuaucuga

SEQ ID NO: 38252 - RNA, 26 nt, Homo sapiens
gcucuugcacaaauuuuuggguuuug

SEQ ID NO: 38253 - RNA, 18 nt, Homo sapiens
gaaauauacuuuaucuga

SEQ ID NO: 38254 - RNA, 26 nt, Homo sapiens
gcucuugcacaaauuuuuggguuuug

SEQ ID NO: 38255 - RNA, 20 nt, Homo sapiens
gcuucuuuuucaugaugcca

SEQ ID NO: 38256 - RNA, 17 nt, Homo sapiens
aacaacaucccuucauc

SEQ ID NO: 38257 - RNA, 20 nt, Homo sapiens
agcuuucucccuuugucuca

SEQ ID NO: 38258 - RNA, 22 nt, Homo sapiens
cgggcgcucuccgccggugccu

SEQ ID NO: 38259 - RNA, 22 nt, Homo sapiens
cuauguuugguauuuugucuua

SEQ ID NO: 38260 - RNA, 22 nt, Homo sapiens
cucuuucuuaaaugugguuugu

SEQ ID NO: 38261 - RNA, 23 nt, Homo sapiens
cuucaucccaaccgggcaucaca

SEQ ID NO: 38262 - RNA, 18 nt, Homo sapiens
gaggucaauguggagcug

SEQ ID NO: 38263 - RNA, 20 nt, Homo sapiens
ugagaaacuaggugaaacug

SEQ ID NO: 38264 - RNA, 21 nt, Homo sapiens
aucuuggcucacugcaaccuc

SEQ ID NO: 38265 - RNA, 18 nt, Homo sapiens
caccauucuccugccuca

SEQ ID NO: 38266 - RNA, 19 nt, Homo sapiens
cugcaagcuccgccuccca

SEQ ID NO: 38267 - RNA, 22 nt, Homo sapiens
cugggauuacaggcacccauca

SEQ ID NO: 38268 - RNA, 18 nt, Homo sapiens
uccgccuccuggguucaa

SEQ ID NO: 38269 - RNA, 17 nt, Homo sapiens
ucugaccucaugaucca

SEQ ID NO: 38270 - RNA, 20 nt, Homo sapiens
ugccauguucccccaucuuu

SEQ ID NO: 38271 - RNA, 20 nt, Homo sapiens
uggccaggcuggucuugaac

SEQ ID NO: 38272 - RNA, 20 nt, Homo sapiens
ugucucuaacacaggcccca

SEQ ID NO: 38273 - RNA, 20 nt, Homo sapiens
uucuccugccucagcuuucc

SEQ ID NO: 38274 - RNA, 20 nt, Homo sapiens
uucugauccuuuauuucugc

SEQ ID NO: 38275 - RNA, 17 nt, Homo sapiens
gcgcgccaggaaccagc

SEQ ID NO: 38276 - RNA, 18 nt, Homo sapiens
uugcaauugcuucccuca

SEQ ID NO: 38277 - RNA, 22 nt, Homo sapiens
cccuggggcagagauuugugag

SEQ ID NO: 38278 - RNA, 19 nt, Homo sapiens
cucagccucuccugccucu

SEQ ID NO: 38279 - RNA, 23 nt, Homo sapiens
gccucucugcccaggcucuccuc

SEQ ID NO: 38280 - RNA, 17 nt, Homo sapiens
gcugagcucucaccuca

SEQ ID NO: 38281 - RNA, 22 nt, Homo sapiens
uccugccucugcaggccuggca

SEQ ID NO: 38282 - RNA, 19 nt, Homo sapiens
ugcccaggcucuccuccuc

SEQ ID NO: 38283 - RNA, 21 nt, Homo sapiens
uguaaacuccaaauguuuaca

SEQ ID NO: 38284 - RNA, 18 nt, Homo sapiens
uugcccaccuccacuucc

SEQ ID NO: 38285 - RNA, 17 nt, Homo sapiens
aaacugcguagcaacga

SEQ ID NO: 38286 - RNA, 17 nt, Homo sapiens
aggaggggacggggaga

SEQ ID NO: 38287 - RNA, 18 nt, Homo sapiens
accugacuggagcucaga

SEQ ID NO: 38288 - RNA, 18 nt, Homo sapiens
caagcuccugcauuuggc

SEQ ID NO: 38289 - RNA, 18 nt, Homo sapiens
aagggaaggcaaagucca

SEQ ID NO: 38290 - RNA, 17 nt, Homo sapiens
gaaaaaggaagccacug

SEQ ID NO: 38291 - RNA, 18 nt, Homo sapiens
ggugcagcacuuaaacug

SEQ ID NO: 38292 - RNA, 25 nt, Homo sapiens
uaaauugacuucaguggugagacug

SEQ ID NO: 38293 - RNA, 19 nt, Homo sapiens
uaagaucaugguuuagggu

SEQ ID NO: 38294 - RNA, 18 nt, Homo sapiens
ucacacuggcuccagaca

SEQ ID NO: 38295 - RNA, 21 nt, Homo sapiens
uucaagcugcugacucacuuu

SEQ ID NO: 38296 - RNA, 19 nt, Homo sapiens
uugcaaaacauugcugccu

SEQ ID NO: 38297 - RNA, 18 nt, Homo sapiens
uuguggcuggucuggcuu

SEQ ID NO: 38298 - RNA, 20 nt, Homo sapiens
aacccagacccaccuccugc

SEQ ID NO: 38299 - RNA, 21 nt, Homo sapiens
cauccuccucuuccucagaug

SEQ ID NO: 38300 - RNA, 22 nt, Homo sapiens
cccagacccaccuccugcccca

SEQ ID NO: 38301 - RNA, 19 nt, Homo sapiens
ccccguugcaggccuggca

SEQ ID NO: 38302 - RNA, 17 nt, Homo sapiens
ccccucuugccucagga

SEQ ID NO: 38303 - RNA, 21 nt, Homo sapiens
ccuugaugggcaggcuuggaa

SEQ ID NO: 38304 - RNA, 19 nt, Homo sapiens
cuucuucauggcugcguug

SEQ ID NO: 38305 - RNA, 24 nt, Homo sapiens
guuugaacugcuccucccuggccu

SEQ ID NO: 38306 - RNA, 18 nt, Homo sapiens
uauggugucgcuuggcua

SEQ ID NO: 38307 - RNA, 16 nt, Homo sapiens
caagaaugugcuggac

SEQ ID NO: 38308 - RNA, 21 nt, Homo sapiens
cuccgugggggaggagcugua

SEQ ID NO: 38309 - RNA, 22 nt, Homo sapiens
uuccuggucacccugccucgga

SEQ ID NO: 38310 - RNA, 19 nt, Homo sapiens
uaguguuugacuacugcua

SEQ ID NO: 38311 - RNA, 25 nt, Homo sapiens
ucacccuccugucccccccaccucc

SEQ ID NO: 38312 - RNA, 19 nt, Homo sapiens
aagcaauucuccugccuca

SEQ ID NO: 38313 - RNA, 20 nt, Homo sapiens
uaucugugacugucauacua

SEQ ID NO: 38314 - RNA, 19 nt, Homo sapiens
gcaagaaaggaguuugcca

SEQ ID NO: 38315 - RNA, 20 nt, Homo sapiens
acccugcagucuccuugcca

SEQ ID NO: 38316 - RNA, 19 nt, Homo sapiens
ccgccugcaugccgccuca

SEQ ID NO: 38317 - RNA, 19 nt, Homo sapiens
cuaaaggcaccgcaagcug

SEQ ID NO: 38318 - RNA, 22 nt, Homo sapiens
cugugaacucaaggccuucccu

SEQ ID NO: 38319 - RNA, 22 nt, Homo sapiens
gcgaggccccagcucugcugcu

SEQ ID NO: 38320 - RNA, 21 nt, Homo sapiens
ggaggggacugcaugggcauc

SEQ ID NO: 38321 - RNA, 18 nt, Homo sapiens
uagaaaauacagauccua

SEQ ID NO: 38322 - RNA, 19 nt, Homo sapiens
ucccugccccaggcgugca

SEQ ID NO: 38323 - RNA, 19 nt, Homo sapiens
uggcccuggugagaggcua

SEQ ID NO: 38324 - RNA, 18 nt, Homo sapiens
aaucucaaagauuugcag

SEQ ID NO: 38325 - RNA, 23 nt, Homo sapiens
auucaagugaaaacagaugugug

SEQ ID NO: 38326 - RNA, 18 nt, Homo sapiens
cuugaaacagaccucuuc

SEQ ID NO: 38327 - RNA, 22 nt, Homo sapiens
cuacuucggugauggagauggg

SEQ ID NO: 38328 - RNA, 20 nt, Homo sapiens
acagacacagcgcugcccag

SEQ ID NO: 38329 - RNA, 18 nt, Homo sapiens
cauggccucaccugcuca

SEQ ID NO: 38330 - RNA, 18 nt, Homo sapiens
ccaggcccacgcucaaca

SEQ ID NO: 38331 - RNA, 25 nt, Homo sapiens
ccuguuucuggacucaguggacuca

SEQ ID NO: 38332 - RNA, 22 nt, Homo sapiens
cgccauggccucaccugcucac

SEQ ID NO: 38333 - RNA, 17 nt, Homo sapiens
ucaccugcucacgggca

SEQ ID NO: 38334 - RNA, 18 nt, Homo sapiens
ucuaagaaauauuuucuu

SEQ ID NO: 38335 - RNA, 28 nt, Homo sapiens
aggcaccuacaggaaaaauuucauacca

SEQ ID NO: 38336 - RNA, 21 nt, Homo sapiens
auccuggcucacugcaaucuc

SEQ ID NO: 38337 - RNA, 19 nt, Homo sapiens
caggaaaaauuucauacca

SEQ ID NO: 38338 - RNA, 18 nt, Homo sapiens
uccaucucccggguucaa

SEQ ID NO: 38339 - RNA, 18 nt, Homo sapiens
ucugccagccaaguggca

SEQ ID NO: 38340 - RNA, 22 nt, Homo sapiens
aggacaaggcgccccgggccca

SEQ ID NO: 38341 - RNA, 26 nt, Homo sapiens
cacgaagucaagaaccaaacagcuca

SEQ ID NO: 38342 - RNA, 24 nt, Homo sapiens
ugcuauucaaagauggacuauuga

SEQ ID NO: 38343 - RNA, 19 nt, Homo sapiens
aagcuacaagaagucccca

SEQ ID NO: 38344 - RNA, 18 nt, Homo sapiens
aucucaccaacugcaaac

SEQ ID NO: 38345 - RNA, 23 nt, Homo sapiens
ccuuucauaauuacuuuagcuuu

SEQ ID NO: 38346 - RNA, 21 nt, Homo sapiens
ggccugaucugcaaagcugca

SEQ ID NO: 38347 - RNA, 17 nt, Homo sapiens
ggcuuucucuaaauccu

SEQ ID NO: 38348 - RNA, 19 nt, Homo sapiens
gagaggaggacagagauga

SEQ ID NO: 38349 - RNA, 22 nt, Homo sapiens
aauguggcaaauuuuucagaca

SEQ ID NO: 38350 - RNA, 18 nt, Homo sapiens
uccgccuccuggguucaa

SEQ ID NO: 38351 - RNA, 18 nt, Homo sapiens
auuucacacagagccccu

SEQ ID NO: 38352 - RNA, 22 nt, Homo sapiens
caagaucgugccauuccacucc

SEQ ID NO: 38353 - RNA, 16 nt, Homo sapiens
ugcccagaccaguucc

SEQ ID NO: 38354 - RNA, 17 nt, Homo sapiens
gguuuuggcucuaccgg

SEQ ID NO: 38355 - RNA, 17 nt, Homo sapiens
ccaaccuuugugccaau

SEQ ID NO: 38356 - RNA, 21 nt, Homo sapiens
gagagguuaaguugcuugcca

SEQ ID NO: 38357 - RNA, 19 nt, Homo sapiens
caucuuaaaacagaucaga

SEQ ID NO: 38358 - RNA, 22 nt, Homo sapiens
ccagcagcagccagggccugcu

SEQ ID NO: 38359 - RNA, 19 nt, Homo sapiens
guggagcgcggggcccuga

SEQ ID NO: 38360 - RNA, 21 nt, Homo sapiens
ucccaauucuuucucugcccc

SEQ ID NO: 38361 - RNA, 21 nt, Homo sapiens
agaagggccucuugagugcga

SEQ ID NO: 38362 - RNA, 18 nt, Homo sapiens
ucugacagcaguaacuca

SEQ ID NO: 38363 - RNA, 19 nt, Homo sapiens
ugcauuugccuccagccca

SEQ ID NO: 38364 - RNA, 22 nt, Homo sapiens
uggacugcccuguaucuaaguc

SEQ ID NO: 38365 - RNA, 21 nt, Homo sapiens
uuuuuuguccagccugccgcu

SEQ ID NO: 38366 - RNA, 22 nt, Homo sapiens
agacggcucgcacugcgacccg

SEQ ID NO: 38367 - RNA, 17 nt, Homo sapiens
caagaacgcagcgugca

SEQ ID NO: 38368 - RNA, 23 nt, Homo sapiens
cgagauggacccugggcucggcg

SEQ ID NO: 38369 - RNA, 20 nt, Homo sapiens
ucccaggaggccacacugca

SEQ ID NO: 38370 - RNA, 24 nt, Homo sapiens
ccucccaguccauagguugcuuuu

SEQ ID NO: 38371 - RNA, 18 nt, Homo sapiens
ccuggcugggcuggcgga

SEQ ID NO: 38372 - RNA, 19 nt, Homo sapiens
cugcaagcuccgccuccca

SEQ ID NO: 38373 - RNA, 18 nt, Homo sapiens
uucuacaguauuuaucuu

SEQ ID NO: 38374 - RNA, 19 nt, Homo sapiens
aaaccuuuucuccccuuuc

SEQ ID NO: 38375 - RNA, 19 nt, Homo sapiens
agaggagaaauaaaaccuu

SEQ ID NO: 38376 - RNA, 18 nt, Homo sapiens
cacacaggcacccaccca

SEQ ID NO: 38377 - RNA, 19 nt, Homo sapiens
cauugguguguuuagagau

SEQ ID NO: 38378 - RNA, 17 nt, Homo sapiens
gggaagggggcauugac

SEQ ID NO: 38379 - RNA, 16 nt, Homo sapiens
uuggaugcugccuuac

SEQ ID NO: 38380 - RNA, 18 nt, Homo sapiens
caagaauggcuugaauca

SEQ ID NO: 38381 - RNA, 19 nt, Homo sapiens
aggugggccugggaacagg

SEQ ID NO: 38382 - RNA, 18 nt, Homo sapiens
cuggucgcaauugcuucu

SEQ ID NO: 38383 - RNA, 21 nt, Homo sapiens
ccauacggugaggcaaugagg

SEQ ID NO: 38384 - RNA, 18 nt, Homo sapiens
ccugcaaccuccaccucc

SEQ ID NO: 38385 - RNA, 19 nt, Homo sapiens
cugcaaccuccaccuccca

SEQ ID NO: 38386 - RNA, 21 nt, Homo sapiens
cuguguauccaccaugcagac

SEQ ID NO: 38387 - RNA, 23 nt, Homo sapiens
gagcugcgcacaccccaaggcca

SEQ ID NO: 38388 - RNA, 17 nt, Homo sapiens
ucaagugauucuccugc

SEQ ID NO: 38389 - RNA, 18 nt, Homo sapiens
uccaccucccagguucaa

SEQ ID NO: 38390 - RNA, 19 nt, Homo sapiens
accucugucacacacacaa

SEQ ID NO: 38391 - RNA, 18 nt, Homo sapiens
agcagaaaaacucuguga

SEQ ID NO: 38392 - RNA, 17 nt, Homo sapiens
aggcaggauaaucacuu

SEQ ID NO: 38393 - RNA, 22 nt, Homo sapiens
gagccaagaucgcgccacugca

SEQ ID NO: 38394 - RNA, 19 nt, Homo sapiens
uaaaaaugacauauuuggu

SEQ ID NO: 38395 - RNA, 15 nt, Homo sapiens
ucaugaaauaucuca

SEQ ID NO: 38396 - RNA, 20 nt, Homo sapiens
cagaaaacucagucuuuuca

SEQ ID NO: 38397 - RNA, 19 nt, Homo sapiens
gcccaccccacucacacuc

SEQ ID NO: 38398 - RNA, 20 nt, Homo sapiens
gacggugccgagaagcagcu

SEQ ID NO: 38399 - RNA, 21 nt, Homo sapiens
gggcgccacgagcagguggug

SEQ ID NO: 38400 - RNA, 20 nt, Homo sapiens
acucccagggacucugggga

SEQ ID NO: 38401 - RNA, 17 nt, Homo sapiens
cagauucuggcauccca

SEQ ID NO: 38402 - RNA, 18 nt, Homo sapiens
gcccgcaucccacccucc

SEQ ID NO: 38403 - RNA, 24 nt, Homo sapiens
uccccaccgugaccugccuggccu

SEQ ID NO: 38404 - RNA, 21 nt, Homo sapiens
uuuuggcggcuguaguugugg

SEQ ID NO: 38405 - RNA, 21 nt, Homo sapiens
cccuggcuagcuucccagaga

SEQ ID NO: 38406 - RNA, 27 nt, Homo sapiens
agggauuugcggccgggacccaccccc

SEQ ID NO: 38407 - RNA, 18 nt, Homo sapiens
agaaacguucccaaacuc

SEQ ID NO: 38408 - RNA, 21 nt, Homo sapiens
agccacgucccaagccaccug

SEQ ID NO: 38409 - RNA, 22 nt, Homo sapiens
caucugcacacacccccaaggu

SEQ ID NO: 38410 - RNA, 18 nt, Homo sapiens
ccaccgucccacuccaca

SEQ ID NO: 38411 - RNA, 20 nt, Homo sapiens
cccccgcaggccaccaggca

SEQ ID NO: 38412 - RNA, 22 nt, Homo sapiens
cgagguuaugcucaccugguca

SEQ ID NO: 38413 - RNA, 18 nt, Homo sapiens
cguagcugcucacaccag

SEQ ID NO: 38414 - RNA, 18 nt, Homo sapiens
gauagaaacauaggcacc

SEQ ID NO: 38415 - RNA, 15 nt, Homo sapiens
ggacaucgucugugu

SEQ ID NO: 38416 - RNA, 22 nt, Homo sapiens
uccagugcccucccucuguucc

SEQ ID NO: 38417 - RNA, 20 nt, Homo sapiens
ugagauucaggguggggcug

SEQ ID NO: 38418 - RNA, 23 nt, Homo sapiens
gggggaggaggcuggggaaagcc

SEQ ID NO: 38419 - RNA, 21 nt, Homo sapiens
cacuugugcagagacacgcgc

SEQ ID NO: 38420 - RNA, 17 nt, Homo sapiens
cgcgugugcaccacagg

SEQ ID NO: 38421 - RNA, 18 nt, Homo sapiens
gccaaggccccgcaccca

SEQ ID NO: 38422 - RNA, 21 nt, Homo sapiens
auauuucuggaauccaccucu

SEQ ID NO: 38423 - RNA, 19 nt, Homo sapiens
uuaaagcacacauucuuca

SEQ ID NO: 38424 - RNA, 22 nt, Homo sapiens
cauuccaagauguggccauuga

SEQ ID NO: 38425 - RNA, 22 nt, Homo sapiens
cccagaaaucugaacguucgac

SEQ ID NO: 38426 - RNA, 19 nt, Homo sapiens
guauccucacacagagcca

SEQ ID NO: 38427 - RNA, 18 nt, Homo sapiens
guguggaccauugcuuga

SEQ ID NO: 38428 - RNA, 20 nt, Homo sapiens
ucauagugccagagacacca

SEQ ID NO: 38429 - RNA, 18 nt, Homo sapiens
ucccucacuaugccuuca

SEQ ID NO: 38430 - RNA, 19 nt, Homo sapiens
ucccuguucccucuggugu

SEQ ID NO: 38431 - RNA, 22 nt, Homo sapiens
uguacaagcucaugaucagcca

SEQ ID NO: 38432 - RNA, 20 nt, Homo sapiens
gcuguuucccuuguaccaga

SEQ ID NO: 38433 - RNA, 23 nt, Homo sapiens
aaaguauuauauuuucuacguca

SEQ ID NO: 38434 - RNA, 16 nt, Homo sapiens
auguaccagauauucc

SEQ ID NO: 38435 - RNA, 21 nt, Homo sapiens
caucacuagcaauuuuccuga

SEQ ID NO: 38436 - RNA, 22 nt, Homo sapiens
guuggcgauaccucacauccua

SEQ ID NO: 38437 - RNA, 18 nt, Homo sapiens
ugagccucaguuuccaca

SEQ ID NO: 38438 - RNA, 19 nt, Homo sapiens
uguaccagauauuccugga

SEQ ID NO: 38439 - RNA, 20 nt, Homo sapiens
cgcccccgcgcggggccuua

SEQ ID NO: 38440 - RNA, 17 nt, Homo sapiens
gaugcccugcccaccuc

SEQ ID NO: 38441 - RNA, 19 nt, Homo sapiens
ugacgggagccucugcgaa

SEQ ID NO: 38442 - RNA, 19 nt, Homo sapiens
uuguauuaagagccaauga

SEQ ID NO: 38443 - RNA, 18 nt, Homo sapiens
caggcccccaguccccuc

SEQ ID NO: 38444 - RNA, 22 nt, Homo sapiens
ccucccagaaauaugagcucag

SEQ ID NO: 38445 - RNA, 15 nt, Homo sapiens
cuccuucggccuggu

SEQ ID NO: 38446 - RNA, 17 nt, Homo sapiens
ggacuagggugaggcug

SEQ ID NO: 38447 - RNA, 16 nt, Homo sapiens
ggagucuccauccuca

SEQ ID NO: 38448 - RNA, 22 nt, Homo sapiens
ugcccagagccucuugccccag

SEQ ID NO: 38449 - RNA, 23 nt, Homo sapiens
augacacacuccucggucauucc

SEQ ID NO: 38450 - RNA, 22 nt, Homo sapiens
cccugcaguggggacuucgugg

SEQ ID NO: 38451 - RNA, 23 nt, Homo sapiens
cgagcagccgcugggacgccaug

SEQ ID NO: 38452 - RNA, 24 nt, Homo sapiens
gcagaugccccacaccaccagucu

SEQ ID NO: 38453 - RNA, 20 nt, Homo sapiens
gucgcaggauccggcugugg

SEQ ID NO: 38454 - RNA, 18 nt, Homo sapiens
aagcccuggccaagauga

SEQ ID NO: 38455 - RNA, 24 nt, Homo sapiens
ccaaaggagcaagccaaaaccuca

SEQ ID NO: 38456 - RNA, 21 nt, Homo sapiens
ccuugggggccgggcacacua

SEQ ID NO: 38457 - RNA, 19 nt, Homo sapiens
gcaagggccucucgagcca

SEQ ID NO: 38458 - RNA, 19 nt, Homo sapiens
gccaugucaaggcccccca

SEQ ID NO: 38459 - RNA, 21 nt, Homo sapiens
gcgaguucuguggugaguucu

SEQ ID NO: 38460 - RNA, 22 nt, Homo sapiens
ugggugggggccagugggguug

SEQ ID NO: 38461 - RNA, 18 nt, Homo sapiens
aacugucaucucuacccu

SEQ ID NO: 38462 - RNA, 23 nt, Homo sapiens
gguaaaaugucaggaacaacuuu

SEQ ID NO: 38463 - RNA, 22 nt, Homo sapiens
ggcaagaagggcaggcucacca

SEQ ID NO: 38464 - RNA, 19 nt, Homo sapiens
auucuccgccugaguugca

SEQ ID NO: 38465 - RNA, 23 nt, Homo sapiens
cacccaagccccccaggccccaa

SEQ ID NO: 38466 - RNA, 19 nt, Homo sapiens
ccuccacccaagcccccca

SEQ ID NO: 38467 - RNA, 19 nt, Homo sapiens
gccagcggcuguuuguucc

SEQ ID NO: 38468 - RNA, 17 nt, Homo sapiens
ggcagggucaggguggc

SEQ ID NO: 38469 - RNA, 22 nt, Homo sapiens
ugaccucagugggcagguagcu

SEQ ID NO: 38470 - RNA, 20 nt, Homo sapiens
cagcuuguuggcccugguca

SEQ ID NO: 38471 - RNA, 21 nt, Homo sapiens
uggaugccaguggugaggcug

SEQ ID NO: 38472 - RNA, 20 nt, Homo sapiens
uggggagcugguugugggug

SEQ ID NO: 38473 - RNA, 22 nt, Homo sapiens
ugggguccaggcugggcccagu

SEQ ID NO: 38474 - RNA, 21 nt, Homo sapiens
agcuacaaguacucaaggcca

SEQ ID NO: 38475 - RNA, 22 nt, Homo sapiens
cgcagcucacugcaaucucugc

SEQ ID NO: 38476 - RNA, 22 nt, Homo sapiens
gagccaagaucgcgccacugca

SEQ ID NO: 38477 - RNA, 21 nt, Homo sapiens
gcagcucacugcaaucucugc

SEQ ID NO: 38478 - RNA, 19 nt, Homo sapiens
accagacaguggaauauua

SEQ ID NO: 38479 - RNA, 22 nt, Homo sapiens
agaaaaaagaaagagagauucc

SEQ ID NO: 38480 - RNA, 21 nt, Homo sapiens
agccaccccaggcgcccauca

SEQ ID NO: 38481 - RNA, 18 nt, Homo sapiens
ggcacagcuccucccuca

SEQ ID NO: 38482 - RNA, 17 nt, Homo sapiens
aaccucaguucugugaa

SEQ ID NO: 38483 - RNA, 20 nt, Homo sapiens
auuuaauugauuuccaaguu

SEQ ID NO: 38484 - RNA, 18 nt, Homo sapiens
ccugcaaccuccaccucc

SEQ ID NO: 38485 - RNA, 17 nt, Homo sapiens
ucaagcgauucuuaugc

SEQ ID NO: 38486 - RNA, 18 nt, Homo sapiens
uccaccuccuggguucaa

SEQ ID NO: 38487 - RNA, 22 nt, Homo sapiens
uuggacccccgggcuggcugca

SEQ ID NO: 38488 - RNA, 21 nt, Homo sapiens
uuucuaauuauucaucauuac

SEQ ID NO: 38489 - RNA, 18 nt, Homo sapiens
ggcacuguugcagaccca

SEQ ID NO: 38490 - RNA, 17 nt, Homo sapiens
accccacaagugugaaa

SEQ ID NO: 38491 - RNA, 22 nt, Homo sapiens
gagccaagauuguaccacugca

SEQ ID NO: 38492 - RNA, 19 nt, Homo sapiens
ggccgggugcgguggcuua

SEQ ID NO: 38493 - RNA, 20 nt, Homo sapiens
aaguggcuuugacguggggc

SEQ ID NO: 38494 - RNA, 22 nt, Homo sapiens
aggcacucgccuguccacuucu

SEQ ID NO: 38495 - RNA, 23 nt, Homo sapiens
ggguguugacacaggcgccccuc

SEQ ID NO: 38496 - RNA, 17 nt, Homo sapiens
cgcagagcagagccugg

SEQ ID NO: 38497 - RNA, 18 nt, Homo sapiens
cugucuugccugcugucc

SEQ ID NO: 38498 - RNA, 19 nt, Homo sapiens
caccaccaccaccagcacc

SEQ ID NO: 38499 - RNA, 19 nt, Homo sapiens
caccaccaccaccagcacc

SEQ ID NO: 38500 - RNA, 21 nt, Homo sapiens
cuaugugagaacaaauaccuu

SEQ ID NO: 38501 - RNA, 19 nt, Homo sapiens
cuuccucagacaucuccau

SEQ ID NO: 38502 - RNA, 22 nt, Homo sapiens
gagccaagaucacaccacugca

SEQ ID NO: 38503 - RNA, 21 nt, Homo sapiens
gcaaguagguucaaguuuuau

SEQ ID NO: 38504 - RNA, 20 nt, Homo sapiens
guaagucaucgcugagcuuu

SEQ ID NO: 38505 - RNA, 20 nt, Homo sapiens
uccagauucuuauuccugcc

SEQ ID NO: 38506 - RNA, 24 nt, Homo sapiens
uugcuguuugucuuugcuugugau

SEQ ID NO: 38507 - RNA, 21 nt, Homo sapiens
acacaccccaccccguuuuuc

SEQ ID NO: 38508 - RNA, 23 nt, Homo sapiens
ccugccuccacccuuuccaacaa

SEQ ID NO: 38509 - RNA, 21 nt, Homo sapiens
cucagcugcgaccucuggccu

SEQ ID NO: 38510 - RNA, 19 nt, Homo sapiens
cuccgccuccccugcccuc

SEQ ID NO: 38511 - RNA, 20 nt, Homo sapiens
uaaacgggcugagcguucca

SEQ ID NO: 38512 - RNA, 19 nt, Homo sapiens
agcuuucauuaaaauguca

SEQ ID NO: 38513 - RNA, 21 nt, Homo sapiens
cagaagcaaagccucauugca

SEQ ID NO: 38514 - RNA, 23 nt, Homo sapiens
guaguaagauagugagcauucau

SEQ ID NO: 38515 - RNA, 19 nt, Homo sapiens
uaaaauauguugaaaggca

SEQ ID NO: 38516 - RNA, 21 nt, Homo sapiens
caaggaaauggacaaacuaca

SEQ ID NO: 38517 - RNA, 17 nt, Homo sapiens
cccgauccuucuucuga

SEQ ID NO: 38518 - RNA, 19 nt, Homo sapiens
cuucuagguauuugcccaa

SEQ ID NO: 38519 - RNA, 22 nt, Homo sapiens
ugcugugaaaagcuucauucca

SEQ ID NO: 38520 - RNA, 21 nt, Homo sapiens
cuggagcagagcgggcugcga

SEQ ID NO: 38521 - RNA, 17 nt, Homo sapiens
aggcugagaccugggaa

SEQ ID NO: 38522 - RNA, 18 nt, Homo sapiens
aggauuaugcuucacuca

SEQ ID NO: 38523 - RNA, 22 nt, Homo sapiens
ccaggacauuccaugugccuca

SEQ ID NO: 38524 - RNA, 17 nt, Homo sapiens
cccuuuuuccuuuacuc

SEQ ID NO: 38525 - RNA, 19 nt, Homo sapiens
acguagauucgggcaaguc

SEQ ID NO: 38526 - RNA, 20 nt, Homo sapiens
ccaagcugggagucugggga

SEQ ID NO: 38527 - RNA, 23 nt, Homo sapiens
cccaggcagcuggacagcaccca

SEQ ID NO: 38528 - RNA, 22 nt, Homo sapiens
cccuggugacaaagccuuugga

SEQ ID NO: 38529 - RNA, 21 nt, Homo sapiens
ggcacacacguguuaugaccg

SEQ ID NO: 38530 - RNA, 20 nt, Homo sapiens
caaggagaugacgggggcua

SEQ ID NO: 38531 - RNA, 22 nt, Homo sapiens
accuggccagacacugcacuca

SEQ ID NO: 38532 - RNA, 19 nt, Homo sapiens
cagaaggaaugaaggccug

SEQ ID NO: 38533 - RNA, 19 nt, Homo sapiens
ccccacccccagccccagc

SEQ ID NO: 38534 - RNA, 19 nt, Homo sapiens
cccuuccccacccccaucc

SEQ ID NO: 38535 - RNA, 19 nt, Homo sapiens
cuuccccacccccauccca

SEQ ID NO: 38536 - RNA, 18 nt, Homo sapiens
ggggccagccagugucug

SEQ ID NO: 38537 - RNA, 20 nt, Homo sapiens
uguugaaauguuucuuugga

SEQ ID NO: 38538 - RNA, 19 nt, Homo sapiens
agccaacacauauggucaa

SEQ ID NO: 38539 - RNA, 27 nt, Homo sapiens
cccgggcggccccgcuccagcauccca

SEQ ID NO: 38540 - RNA, 18 nt, Homo sapiens
cuggcgaggaggcugcga

SEQ ID NO: 38541 - RNA, 19 nt, Homo sapiens
gcaucccagcuccugcacu

SEQ ID NO: 38542 - RNA, 20 nt, Homo sapiens
gcuugaaccguaauuuggcu

SEQ ID NO: 38543 - RNA, 21 nt, Homo sapiens
ugugacuuuagaauggaacug

SEQ ID NO: 38544 - RNA, 21 nt, Homo sapiens
uugucucuuccuuucaccuca

SEQ ID NO: 38545 - RNA, 24 nt, Homo sapiens
augccucaggcuugcuccugcugu

SEQ ID NO: 38546 - RNA, 22 nt, Homo sapiens
cgaacagccacaagcagccaug

SEQ ID NO: 38547 - RNA, 18 nt, Homo sapiens
aacuucauuacuacccag

SEQ ID NO: 38548 - RNA, 18 nt, Homo sapiens
gaugucuuuucugccuuu

SEQ ID NO: 38549 - RNA, 19 nt, Homo sapiens
gcucuuaacauuuguugua

SEQ ID NO: 38550 - RNA, 20 nt, Homo sapiens
uucagacaugcaaucaccua

SEQ ID NO: 38551 - RNA, 20 nt, Homo sapiens
uucugccuuucuuuugccuu

SEQ ID NO: 38552 - RNA, 21 nt, Homo sapiens
auugaacaggacaacugagga

SEQ ID NO: 38553 - RNA, 17 nt, Homo sapiens
cauguucuugcugaaaa

SEQ ID NO: 38554 - RNA, 18 nt, Homo sapiens
ggaaagugguuugaaaua

SEQ ID NO: 38555 - RNA, 18 nt, Homo sapiens
acuagacaaugaucauua

SEQ ID NO: 38556 - RNA, 17 nt, Homo sapiens
cccacccacaccuguga

SEQ ID NO: 38557 - RNA, 21 nt, Homo sapiens
cugccaauucucaguguggua

SEQ ID NO: 38558 - RNA, 20 nt, Homo sapiens
cuuuuuaauuggagaauuga

SEQ ID NO: 38559 - RNA, 24 nt, Homo sapiens
gagcucaacauuccauuccaucca

SEQ ID NO: 38560 - RNA, 18 nt, Homo sapiens
gagcuuuggcgggggaug

SEQ ID NO: 38561 - RNA, 21 nt, Homo sapiens
uggauggaucuuugcaggagc

SEQ ID NO: 38562 - RNA, 19 nt, Homo sapiens
acccuaaaacugaggcacu

SEQ ID NO: 38563 - RNA, 21 nt, Homo sapiens
auuugaacaaauuccuggcuc

SEQ ID NO: 38564 - RNA, 22 nt, Homo sapiens
ccaacaggaugaacgugugcaa

SEQ ID NO: 38565 - RNA, 18 nt, Homo sapiens
auucagggauauuggaga

SEQ ID NO: 38566 - RNA, 26 nt, Homo sapiens
uauuggagaagauauuccacuagaca

SEQ ID NO: 38567 - RNA, 21 nt, Homo sapiens
gaagugcccaagucuuccuuc

SEQ ID NO: 38568 - RNA, 25 nt, Homo sapiens
accuuggcugugauuggcuugguuc

SEQ ID NO: 38569 - RNA, 19 nt, Homo sapiens
ccaaucacuacaaccacua

SEQ ID NO: 38570 - RNA, 19 nt, Homo sapiens
aaugaugguugucugguuu

SEQ ID NO: 38571 - RNA, 20 nt, Homo sapiens
auagcacucaaagcuuauca

SEQ ID NO: 38572 - RNA, 19 nt, Homo sapiens
gcaauggaugagugcugga

SEQ ID NO: 38573 - RNA, 22 nt, Homo sapiens
gcccaccccaucuaacuucuga

SEQ ID NO: 38574 - RNA, 19 nt, Homo sapiens
ggagcccaccugccuuucc

SEQ ID NO: 38575 - RNA, 17 nt, Homo sapiens
ugcuucugugcuugcug

SEQ ID NO: 38576 - RNA, 17 nt, Homo sapiens
ugguuuuguuguuuuua

SEQ ID NO: 38577 - RNA, 19 nt, Homo sapiens
aaagugcugcaguaaacca

SEQ ID NO: 38578 - RNA, 17 nt, Homo sapiens
caccacagcguccuccu

SEQ ID NO: 38579 - RNA, 20 nt, Homo sapiens
cacuccacugccugcuccuc

SEQ ID NO: 38580 - RNA, 19 nt, Homo sapiens
cagaaauguaacucaccca

SEQ ID NO: 38581 - RNA, 18 nt, Homo sapiens
cagaauaagccuuucaaa

SEQ ID NO: 38582 - RNA, 22 nt, Homo sapiens
ccuguaucagaaauguaacuca

SEQ ID NO: 38583 - RNA, 16 nt, Homo sapiens
gcacccagugcugcug

SEQ ID NO: 38584 - RNA, 18 nt, Homo sapiens
uacauuuacaccuguaaa

SEQ ID NO: 38585 - RNA, 17 nt, Homo sapiens
uucuccugcuucagccu

SEQ ID NO: 38586 - RNA, 19 nt, Homo sapiens
acacagggguccccacgca

SEQ ID NO: 38587 - RNA, 24 nt, Homo sapiens
agguaugcccucuccucuuccuca

SEQ ID NO: 38588 - RNA, 25 nt, Homo sapiens
aagcguuuucccuucucauaacccc

SEQ ID NO: 38589 - RNA, 19 nt, Homo sapiens
aguccacagaauacccaug

SEQ ID NO: 38590 - RNA, 21 nt, Homo sapiens
agugaaugggauggauguuug

SEQ ID NO: 38591 - RNA, 25 nt, Homo sapiens
aacagaaugagagcaaaggcacaga

SEQ ID NO: 38592 - RNA, 26 nt, Homo sapiens
aucugaguuucuuuggcuucuggcuc

SEQ ID NO: 38593 - RNA, 22 nt, Homo sapiens
cagccuggccaacacagugaaa

SEQ ID NO: 38594 - RNA, 17 nt, Homo sapiens
cuggcaguccugccucc

SEQ ID NO: 38595 - RNA, 22 nt, Homo sapiens
cuucuuugaugggucuuggcuu

SEQ ID NO: 38596 - RNA, 23 nt, Homo sapiens
ucacagcacagagaagcaaccca

SEQ ID NO: 38597 - RNA, 18 nt, Homo sapiens
acauuguaaaacauugcc

SEQ ID NO: 38598 - RNA, 25 nt, Homo sapiens
ccugcaucucuccccuuacucuuca

SEQ ID NO: 38599 - RNA, 25 nt, Homo sapiens
gaaacuuuugaucaaaaccacauug

SEQ ID NO: 38600 - RNA, 18 nt, Homo sapiens
ucaccacuggcaucuaca

SEQ ID NO: 38601 - RNA, 23 nt, Homo sapiens
uuauuucacugcuucaccuucca

SEQ ID NO: 38602 - RNA, 19 nt, Homo sapiens
aaguaccuacccuaccuca

SEQ ID NO: 38603 - RNA, 21 nt, Homo sapiens
aauagcuuaucuauauucuca

SEQ ID NO: 38604 - RNA, 21 nt, Homo sapiens
agucucacucuguugccaggc

SEQ ID NO: 38605 - RNA, 18 nt, Homo sapiens
agugcugugauucacacg

SEQ ID NO: 38606 - RNA, 18 nt, Homo sapiens
cacugcuaguaaucaagg

SEQ ID NO: 38607 - RNA, 17 nt, Homo sapiens
uacugacauugacuagc

SEQ ID NO: 38608 - RNA, 21 nt, Homo sapiens
aucauggagcugagaauuuca

SEQ ID NO: 38609 - RNA, 19 nt, Homo sapiens
ccacaccuggcccacuuuu

SEQ ID NO: 38610 - RNA, 20 nt, Homo sapiens
ucauuuucuuuccuuuauuc

SEQ ID NO: 38611 - RNA, 23 nt, Homo sapiens
uuugcauguaugugaaguuuaua

SEQ ID NO: 38612 - RNA, 21 nt, Homo sapiens
ugggugggggcagcguggggc

SEQ ID NO: 38613 - RNA, 21 nt, Homo sapiens
uccgcugcccaccucuugcca

SEQ ID NO: 38614 - RNA, 17 nt, Homo sapiens
ugauggaaauuagugag

SEQ ID NO: 38615 - RNA, 21 nt, Homo sapiens
uuccccugaagacguuacagc

SEQ ID NO: 38616 - RNA, 16 nt, Homo sapiens
accaaccucugucuug

SEQ ID NO: 38617 - RNA, 18 nt, Homo sapiens
agccccaggguuucccuc

SEQ ID NO: 38618 - RNA, 23 nt, Homo sapiens
ccccugcccaucaaccccucuca

SEQ ID NO: 38619 - RNA, 17 nt, Homo sapiens
ccuucuccuuuccuuca

SEQ ID NO: 38620 - RNA, 17 nt, Homo sapiens
ucugucuugccaccuuu

SEQ ID NO: 38621 - RNA, 24 nt, Homo sapiens
ucuuagaagccuccccugacuuca

SEQ ID NO: 38622 - RNA, 24 nt, Homo sapiens
uuggugucuuaacuccaccacuca

SEQ ID NO: 38623 - RNA, 19 nt, Homo sapiens
auccaauaucaugccccac

SEQ ID NO: 38624 - RNA, 18 nt, Homo sapiens
gucuugucucccauccca

SEQ ID NO: 38625 - RNA, 19 nt, Homo sapiens
uccugagccaagcauccaa

SEQ ID NO: 38626 - RNA, 21 nt, Homo sapiens
uguccagggccucacagggag

SEQ ID NO: 38627 - RNA, 20 nt, Homo sapiens
ccaaaguuauuuuaaucuau

SEQ ID NO: 38628 - RNA, 18 nt, Homo sapiens
gacccucaggugagacua

SEQ ID NO: 38629 - RNA, 20 nt, Homo sapiens
ucagcauuaucaugauauca

SEQ ID NO: 38630 - RNA, 21 nt, Homo sapiens
uucugccucaauguuuacugu

SEQ ID NO: 38631 - RNA, 21 nt, Homo sapiens
agaagucuccaccuggucuuc

SEQ ID NO: 38632 - RNA, 21 nt, Homo sapiens
cugacucauuccagcacuaca

SEQ ID NO: 38633 - RNA, 20 nt, Homo sapiens
ucugaagacaauggacccac

SEQ ID NO: 38634 - RNA, 21 nt, Homo sapiens
uggaugguggugacauggacu

SEQ ID NO: 38635 - RNA, 17 nt, Homo sapiens
ucccagcuugggaagca

SEQ ID NO: 38636 - RNA, 22 nt, Homo sapiens
acucaucuauauauucuguauc

SEQ ID NO: 38637 - RNA, 22 nt, Homo sapiens
agcccccuacauccccccggga

SEQ ID NO: 38638 - RNA, 22 nt, Homo sapiens
guuuugaauauuaacuguguua

SEQ ID NO: 38639 - RNA, 20 nt, Homo sapiens
uggacuccaucaagacaauc

SEQ ID NO: 38640 - RNA, 19 nt, Homo sapiens
augggagcccccauaccca

SEQ ID NO: 38641 - RNA, 25 nt, Homo sapiens
ucucugacaccuugacuuuaaccuu

SEQ ID NO: 38642 - RNA, 20 nt, Homo sapiens
uucaagaccagccuagccaa

SEQ ID NO: 38643 - RNA, 21 nt, Homo sapiens
aggcacagcuccaucguuaca

SEQ ID NO: 38644 - RNA, 18 nt, Homo sapiens
aggcccugaacauucuca

SEQ ID NO: 38645 - RNA, 22 nt, Homo sapiens
ucuaccaugaaagacuugugaa

SEQ ID NO: 38646 - RNA, 19 nt, Homo sapiens
aacacuagaccucuccuga

SEQ ID NO: 38647 - RNA, 20 nt, Homo sapiens
accaugcacaucaucagaga

SEQ ID NO: 38648 - RNA, 19 nt, Homo sapiens
cuuucuuccaagccauggc

SEQ ID NO: 38649 - RNA, 23 nt, Homo sapiens
auguuuuguauaaauuugucaug

SEQ ID NO: 38650 - RNA, 19 nt, Homo sapiens
caacugcacgggacauugu

SEQ ID NO: 38651 - RNA, 21 nt, Homo sapiens
cauuauuccaacugcacggga

SEQ ID NO: 38652 - RNA, 23 nt, Homo sapiens
ccagauuacugguuaaaauccaa

SEQ ID NO: 38653 - RNA, 20 nt, Homo sapiens
ucaccaucucagucuucaaa

SEQ ID NO: 38654 - RNA, 19 nt, Homo sapiens
aaagccgguuucucaguga

SEQ ID NO: 38655 - RNA, 18 nt, Homo sapiens
cuucagaagaacgacaaa

SEQ ID NO: 38656 - RNA, 15 nt, Homo sapiens
gaagaacgacaaaag

SEQ ID NO: 38657 - RNA, 20 nt, Homo sapiens
caauccuaagcaaaaauaac

SEQ ID NO: 38658 - RNA, 18 nt, Homo sapiens
ccagcggcaauguuccag

SEQ ID NO: 38659 - RNA, 19 nt, Homo sapiens
aauaugaacugguauucuc

SEQ ID NO: 38660 - RNA, 21 nt, Homo sapiens
cuucuaguuuugaacucugca

SEQ ID NO: 38661 - RNA, 15 nt, Homo sapiens
ggccuccuucccaca

SEQ ID NO: 38662 - RNA, 19 nt, Homo sapiens
guuuugaacucugcagcag

SEQ ID NO: 38663 - RNA, 20 nt, Homo sapiens
ucccaggucagaggucagca

SEQ ID NO: 38664 - RNA, 19 nt, Homo sapiens
ugggguucagcugagguug

SEQ ID NO: 38665 - RNA, 26 nt, Homo sapiens
ugggugggccgucaggcaugggccug

SEQ ID NO: 38666 - RNA, 22 nt, Homo sapiens
ccuugcccuggaggguuuugag

SEQ ID NO: 38667 - RNA, 20 nt, Homo sapiens
gcuccuggaggcccugggga

SEQ ID NO: 38668 - RNA, 17 nt, Homo sapiens
ucgagugauucuccugc

SEQ ID NO: 38669 - RNA, 20 nt, Homo sapiens
cucugguggugggcaccugu

SEQ ID NO: 38670 - RNA, 22 nt, Homo sapiens
gcccaguuccuuccaggaguca

SEQ ID NO: 38671 - RNA, 17 nt, Homo sapiens
guccccguacuggcuca

SEQ ID NO: 38672 - RNA, 21 nt, Homo sapiens
aaauaccauuaccucuauuca

SEQ ID NO: 38673 - RNA, 18 nt, Homo sapiens
acaccuaaauggaaccca

SEQ ID NO: 38674 - RNA, 20 nt, Homo sapiens
acucagucaucaucaaccca

SEQ ID NO: 38675 - RNA, 21 nt, Homo sapiens
agaacauucaccaucucuaca

SEQ ID NO: 38676 - RNA, 21 nt, Homo sapiens
auuaagugcucaauaaauuua

SEQ ID NO: 38677 - RNA, 18 nt, Homo sapiens
auuuuucucagggcccuc

SEQ ID NO: 38678 - RNA, 23 nt, Homo sapiens
caaaaccuccaagcuuucuggaa

SEQ ID NO: 38679 - RNA, 19 nt, Homo sapiens
cagguggccauuuuucuca

SEQ ID NO: 38680 - RNA, 18 nt, Homo sapiens
ccaagugauugcuggucc

SEQ ID NO: 38681 - RNA, 20 nt, Homo sapiens
gaugcucagcacugcagacc

SEQ ID NO: 38682 - RNA, 20 nt, Homo sapiens
guagauguaacauuucugga

SEQ ID NO: 38683 - RNA, 19 nt, Homo sapiens
ugagcuccagauggagcua

SEQ ID NO: 38684 - RNA, 18 nt, Homo sapiens
uggguggaucaccugagg

SEQ ID NO: 38685 - RNA, 17 nt, Homo sapiens
uugcaaagcaaagccuc

SEQ ID NO: 38686 - RNA, 22 nt, Homo sapiens
aaacccaaaaaaaacaaaaaca

SEQ ID NO: 38687 - RNA, 15 nt, Homo sapiens
agccuucuuucccca

SEQ ID NO: 38688 - RNA, 19 nt, Homo sapiens
agguauauacauagaaugu

SEQ ID NO: 38689 - RNA, 22 nt, Homo sapiens
caggcuucacuuuacaugugau

SEQ ID NO: 38690 - RNA, 21 nt, Homo sapiens
ccaucuccuccaucuaaguaa

SEQ ID NO: 38691 - RNA, 21 nt, Homo sapiens
ucaaacagauguugcauuuca

SEQ ID NO: 38692 - RNA, 21 nt, Homo sapiens
ucagucuucagauguuacaua

SEQ ID NO: 38693 - RNA, 20 nt, Homo sapiens
caccaccacccaggccuccu

SEQ ID NO: 38694 - RNA, 21 nt, Homo sapiens
ccacugcuacagucaccacca

SEQ ID NO: 38695 - RNA, 22 nt, Homo sapiens
cucccacuaguuacccacccca

SEQ ID NO: 38696 - RNA, 15 nt, Homo sapiens
ugcagcucaaucugc

SEQ ID NO: 38697 - RNA, 21 nt, Homo sapiens
aagaaucuucuguuccacauc

SEQ ID NO: 38698 - RNA, 18 nt, Homo sapiens
cagaagaacaaagagccc

SEQ ID NO: 38699 - RNA, 23 nt, Homo sapiens
gacuaaccucuaacaacaaauua

SEQ ID NO: 38700 - RNA, 20 nt, Homo sapiens
ucuuuaacaucuucuuuccu

SEQ ID NO: 38701 - RNA, 21 nt, Homo sapiens
uuccuaugcccucucugugga

SEQ ID NO: 38702 - RNA, 16 nt, Homo sapiens
agccugaaggaguucu

SEQ ID NO: 38703 - RNA, 22 nt, Homo sapiens
caucuagguacucugcuguuca

SEQ ID NO: 38704 - RNA, 20 nt, Homo sapiens
cguggcagcccagcauuugg

SEQ ID NO: 38705 - RNA, 18 nt, Homo sapiens
cugacccaaguuucuuuu

SEQ ID NO: 38706 - RNA, 20 nt, Homo sapiens
cuguggcugccauugccaga

SEQ ID NO: 38707 - RNA, 23 nt, Homo sapiens
gacauuugccaucuagguacucu

SEQ ID NO: 38708 - RNA, 25 nt, Homo sapiens
gccugggcuacucuccuccugguuc

SEQ ID NO: 38709 - RNA, 20 nt, Homo sapiens
ucugaagacaauggacccac

SEQ ID NO: 38710 - RNA, 21 nt, Homo sapiens
uggaugguggugacauggacu

SEQ ID NO: 38711 - RNA, 23 nt, Homo sapiens
accugacaaccauguguacacca

SEQ ID NO: 38712 - RNA, 15 nt, Homo sapiens
ccaccugcugccuca

SEQ ID NO: 38713 - RNA, 18 nt, Homo sapiens
uggguggaucaccugagg

SEQ ID NO: 38714 - RNA, 16 nt, Homo sapiens
gcccccaccaugccac

SEQ ID NO: 38715 - RNA, 22 nt, Homo sapiens
gcgcccagcccccaccaugcca

SEQ ID NO: 38716 - RNA, 16 nt, Homo sapiens
aggccaugucuaugua

SEQ ID NO: 38717 - RNA, 19 nt, Homo sapiens
acuagggaucccacuucuc

SEQ ID NO: 38718 - RNA, 17 nt, Homo sapiens
agccgaacaguagcuca

SEQ ID NO: 38719 - RNA, 18 nt, Homo sapiens
ccugcucacacugccaga

SEQ ID NO: 38720 - RNA, 18 nt, Homo sapiens
uccugcucacacugccag

SEQ ID NO: 38721 - RNA, 18 nt, Homo sapiens
uuccagagugagccguuc

SEQ ID NO: 38722 - RNA, 19 nt, Homo sapiens
uuuuucugcuguugaccuu

SEQ ID NO: 38723 - RNA, 19 nt, Homo sapiens
auccaccaucgaauuccau

SEQ ID NO: 38724 - RNA, 22 nt, Homo sapiens
auuugguggcagcucuuggucc

SEQ ID NO: 38725 - RNA, 20 nt, Homo sapiens
caccaucgaauuccauaaca

SEQ ID NO: 38726 - RNA, 19 nt, Homo sapiens
cauagaaaguaacacccca

SEQ ID NO: 38727 - RNA, 16 nt, Homo sapiens
cccauuucuccucccu

SEQ ID NO: 38728 - RNA, 18 nt, Homo sapiens
ccuucccccaucacaucc

SEQ ID NO: 38729 - RNA, 21 nt, Homo sapiens
cgacagaaguccaauuuucuu

SEQ ID NO: 38730 - RNA, 22 nt, Homo sapiens
gaugcgggcacugcagaccagg

SEQ ID NO: 38731 - RNA, 21 nt, Homo sapiens
gguucgggaaggugacugcuu

SEQ ID NO: 38732 - RNA, 24 nt, Homo sapiens
uacauauaaaugauaucaagauga

SEQ ID NO: 38733 - RNA, 22 nt, Homo sapiens
uuuugagggaucagaaaaguga

SEQ ID NO: 38734 - RNA, 23 nt, Homo sapiens
acagcacuuguuauuuauugagc

SEQ ID NO: 38735 - RNA, 18 nt, Homo sapiens
acaugcccugccuguuuc

SEQ ID NO: 38736 - RNA, 20 nt, Homo sapiens
agcuucccuuacaauguaau

SEQ ID NO: 38737 - RNA, 21 nt, Homo sapiens
auggcucgcucucucacugcu

SEQ ID NO: 38738 - RNA, 20 nt, Homo sapiens
uaugugggcauauuugguug

SEQ ID NO: 38739 - RNA, 18 nt, Homo sapiens
ugcccaacucugaagcca

SEQ ID NO: 38740 - RNA, 19 nt, Homo sapiens
accaauuauggaaagcaac

SEQ ID NO: 38741 - RNA, 21 nt, Homo sapiens
cuacugacaaccaguccucca

SEQ ID NO: 38742 - RNA, 20 nt, Homo sapiens
uaagaggcaguaucugcacu

SEQ ID NO: 38743 - RNA, 22 nt, Homo sapiens
ccaaacaaacaaaacaaacaaa

SEQ ID NO: 38744 - RNA, 19 nt, Homo sapiens
cuugggccgcccagccuca

SEQ ID NO: 38745 - RNA, 22 nt, Homo sapiens
aucugcauugauuaccuggucu

SEQ ID NO: 38746 - RNA, 19 nt, Homo sapiens
aacacacuggaaccucaug

SEQ ID NO: 38747 - RNA, 20 nt, Homo sapiens
agucaucagcacuuaagaaa

SEQ ID NO: 38748 - RNA, 22 nt, Homo sapiens
aucacugauacagucuauguca

SEQ ID NO: 38749 - RNA, 20 nt, Homo sapiens
uggaaagauuuuaccuguga

SEQ ID NO: 38750 - RNA, 22 nt, Homo sapiens
ccuccaccccaaccccuucuca

SEQ ID NO: 38751 - RNA, 21 nt, Homo sapiens
cguguuucucauuuccgugga

SEQ ID NO: 38752 - RNA, 20 nt, Homo sapiens
cuccucacccuacgcaccgc

SEQ ID NO: 38753 - RNA, 19 nt, Homo sapiens
gcaccgcauucugcuccuc

SEQ ID NO: 38754 - RNA, 25 nt, Homo sapiens
gcgccggaagaaccguugucugcca

SEQ ID NO: 38755 - RNA, 17 nt, Homo sapiens
ucaagcgauucucgugc

SEQ ID NO: 38756 - RNA, 20 nt, Homo sapiens
ucauuuccguggacacccac

SEQ ID NO: 38757 - RNA, 18 nt, Homo sapiens
guacagaaaaccaguucc

SEQ ID NO: 38758 - RNA, 17 nt, Homo sapiens
aaugaguaccaggccca

SEQ ID NO: 38759 - RNA, 19 nt, Homo sapiens
cauaauauuaugcauaaua

SEQ ID NO: 38760 - RNA, 18 nt, Homo sapiens
aucugagacccagauccu

SEQ ID NO: 38761 - RNA, 18 nt, Homo sapiens
cccacagcucacuccacu

SEQ ID NO: 38762 - RNA, 19 nt, Homo sapiens
cccccgaccccacagcuca

SEQ ID NO: 38763 - RNA, 19 nt, Homo sapiens
cacccucacucugccuguc

SEQ ID NO: 38764 - RNA, 21 nt, Homo sapiens
cacuuuuacccgcucacugcc

SEQ ID NO: 38765 - RNA, 26 nt, Homo sapiens
ccaucccuccccuccuuuucagguaa

SEQ ID NO: 38766 - RNA, 19 nt, Homo sapiens
gcccaggcccaugacccca

SEQ ID NO: 38767 - RNA, 21 nt, Homo sapiens
ucugguuaucuuccuguuccu

SEQ ID NO: 38768 - RNA, 18 nt, Homo sapiens
ugccacugccaucacugc

SEQ ID NO: 38769 - RNA, 18 nt, Homo sapiens
uuccuguuccuguagcau

SEQ ID NO: 38770 - RNA, 22 nt, Homo sapiens
aaagcuagcacaacggagcuca

SEQ ID NO: 38771 - RNA, 19 nt, Homo sapiens
accuccgcaccuaagcacu

SEQ ID NO: 38772 - RNA, 19 nt, Homo sapiens
uguuccucagcauccccca

SEQ ID NO: 38773 - RNA, 19 nt, Homo sapiens
ccaccccuuaguugaggga

SEQ ID NO: 38774 - RNA, 23 nt, Homo sapiens
uccugauguauuuguaucacuua

SEQ ID NO: 38775 - RNA, 17 nt, Homo sapiens
aagagacucccgucuca

SEQ ID NO: 38776 - RNA, 19 nt, Homo sapiens
cgagacgaaaacggccccg

SEQ ID NO: 38777 - RNA, 17 nt, Homo sapiens
uggacuuccccgcccug

SEQ ID NO: 38778 - RNA, 18 nt, Homo sapiens
uggguggaucaccugagg

SEQ ID NO: 38779 - RNA, 22 nt, Homo sapiens
ucugagcgagcgcggugcuuuu

SEQ ID NO: 38780 - RNA, 19 nt, Homo sapiens
agccuaaacgccaccacca

SEQ ID NO: 38781 - RNA, 23 nt, Homo sapiens
ccacccucaccaucaguacuccc

SEQ ID NO: 38782 - RNA, 20 nt, Homo sapiens
ccaucccaccaccaugugcc

SEQ ID NO: 38783 - RNA, 22 nt, Homo sapiens
ggacauagaaaaagaggcuggc

SEQ ID NO: 38784 - RNA, 20 nt, Homo sapiens
ucugaccuaugcacaagaaa

SEQ ID NO: 38785 - RNA, 20 nt, Homo sapiens
uggauggguccuuuggaacu

SEQ ID NO: 38786 - RNA, 18 nt, Homo sapiens
uguggaugccaccggcuu

SEQ ID NO: 38787 - RNA, 18 nt, Homo sapiens
uuaggagaggaagaaauc

SEQ ID NO: 38788 - RNA, 23 nt, Homo sapiens
cugaaguaugggaggcuucugag

SEQ ID NO: 38789 - RNA, 17 nt, Homo sapiens
auauagaaaaaggaauu

SEQ ID NO: 38790 - RNA, 17 nt, Homo sapiens
caguccuggucugcuca

SEQ ID NO: 38791 - RNA, 22 nt, Homo sapiens
ccucaugggaagcuuccaauaa

SEQ ID NO: 38792 - RNA, 19 nt, Homo sapiens
ccccccggugguguccuca

SEQ ID NO: 38793 - RNA, 23 nt, Homo sapiens
ccguguuacaggaggcuugugag

SEQ ID NO: 38794 - RNA, 17 nt, Homo sapiens
gggcucauaauuguugc

SEQ ID NO: 38795 - RNA, 21 nt, Homo sapiens
uaaccccgucuucuuuuucac

SEQ ID NO: 38796 - RNA, 20 nt, Homo sapiens
uccugagauaagucagguaa

SEQ ID NO: 38797 - RNA, 20 nt, Homo sapiens
ucuuuuucacacuagcucug

SEQ ID NO: 38798 - RNA, 15 nt, Homo sapiens
ugguuuuccuuccuc

SEQ ID NO: 38799 - RNA, 20 nt, Homo sapiens
aaaaggaaaacaaaggcauu

SEQ ID NO: 38800 - RNA, 27 nt, Homo sapiens
gcuuggagucuaccgacugucugucuc

SEQ ID NO: 38801 - RNA, 21 nt, Homo sapiens
uggaucaccgggaugaagcug

SEQ ID NO: 38802 - RNA, 20 nt, Homo sapiens
uuccagaauaggccacccag

SEQ ID NO: 38803 - RNA, 19 nt, Homo sapiens
ugaagaaauaaguucagag

SEQ ID NO: 38804 - RNA, 20 nt, Homo sapiens
gaagccacucaaaccauucc

SEQ ID NO: 38805 - RNA, 19 nt, Homo sapiens
gggcauccuugggccaacu

SEQ ID NO: 38806 - RNA, 21 nt, Homo sapiens
ucucucacuugucuugguuuu

SEQ ID NO: 38807 - RNA, 22 nt, Homo sapiens
uuggaagaggaagagaaguuga

SEQ ID NO: 38808 - RNA, 15 nt, Homo sapiens
aguccauuacaaacu

SEQ ID NO: 38809 - RNA, 21 nt, Homo sapiens
cacaggucaagaacuaaacuc

SEQ ID NO: 38810 - RNA, 21 nt, Homo sapiens
ccaccucuguccacgugcacc

SEQ ID NO: 38811 - RNA, 23 nt, Homo sapiens
guguguguguccucauguggcug

SEQ ID NO: 38812 - RNA, 19 nt, Homo sapiens
ucccacaacaacgcaauga

SEQ ID NO: 38813 - RNA, 17 nt, Homo sapiens
ucucagucauaugccca

SEQ ID NO: 38814 - RNA, 19 nt, Homo sapiens
ucuguccacgugcaccuuu

SEQ ID NO: 38815 - RNA, 21 nt, Homo sapiens
auuuggacucugguuuugccu

SEQ ID NO: 38816 - RNA, 21 nt, Homo sapiens
cgcucuucaucagacuuguca

SEQ ID NO: 38817 - RNA, 16 nt, Homo sapiens
cugacggcccagcgga

SEQ ID NO: 38818 - RNA, 24 nt, Homo sapiens
uagagcugcuucugagugaggcug

SEQ ID NO: 38819 - RNA, 21 nt, Homo sapiens
ucucccugacauaagcaagga

SEQ ID NO: 38820 - RNA, 19 nt, Homo sapiens
cacauagucauuuagauga

SEQ ID NO: 38821 - RNA, 18 nt, Homo sapiens
ccuauggaagauccugau

SEQ ID NO: 38822 - RNA, 24 nt, Homo sapiens
cgccuuucuugcaaccugguacca

SEQ ID NO: 38823 - RNA, 18 nt, Homo sapiens
ucagcaagaggcguucga

SEQ ID NO: 38824 - RNA, 21 nt, Homo sapiens
auccuggguacucaggccucu

SEQ ID NO: 38825 - RNA, 22 nt, Homo sapiens
aaauacuguaaaauccuacuca

SEQ ID NO: 38826 - RNA, 23 nt, Homo sapiens
ccaucuuguguucuguuaugaaa

SEQ ID NO: 38827 - RNA, 24 nt, Homo sapiens
gagacagaaucuuuaguuacuuca

SEQ ID NO: 38828 - RNA, 22 nt, Homo sapiens
uacuuccucacugucagccuaa

SEQ ID NO: 38829 - RNA, 17 nt, Homo sapiens
ucuucccugucaguguu

SEQ ID NO: 38830 - RNA, 18 nt, Homo sapiens
aagacuucuugguaccua

SEQ ID NO: 38831 - RNA, 21 nt, Homo sapiens
caacccuucuugccuacuccu

SEQ ID NO: 38832 - RNA, 18 nt, Homo sapiens
caccagagcucuuggaua

SEQ ID NO: 38833 - RNA, 19 nt, Homo sapiens
cacuugggcacuucacagc

SEQ ID NO: 38834 - RNA, 20 nt, Homo sapiens
cagacacguugagaagcugc

SEQ ID NO: 38835 - RNA, 20 nt, Homo sapiens
cccacugucucaaucugcaa

SEQ ID NO: 38836 - RNA, 21 nt, Homo sapiens
cccuccccuucuccuccagua

SEQ ID NO: 38837 - RNA, 20 nt, Homo sapiens
cccuucuuguggugagacug

SEQ ID NO: 38838 - RNA, 23 nt, Homo sapiens
gacucaaggagacaaccaccuca

SEQ ID NO: 38839 - RNA, 16 nt, Homo sapiens
uucugccuugggggcg

SEQ ID NO: 38840 - RNA, 22 nt, Homo sapiens
gccugagcugugacgggugccc

SEQ ID NO: 38841 - RNA, 20 nt, Homo sapiens
ugcccagaacaugaucucag

SEQ ID NO: 38842 - RNA, 19 nt, Homo sapiens
cagcuggucuacaccaaca

SEQ ID NO: 38843 - RNA, 22 nt, Homo sapiens
auccaaacacauguacaccaaa

SEQ ID NO: 38844 - RNA, 18 nt, Homo sapiens
ucaguauaauuguuccag

SEQ ID NO: 38845 - RNA, 21 nt, Homo sapiens
ccuucccccuucccuccuucc

SEQ ID NO: 38846 - RNA, 21 nt, Homo sapiens
gccuggcaggucaccuggccc

SEQ ID NO: 38847 - RNA, 21 nt, Homo sapiens
aacccagaacaccaccucuca

SEQ ID NO: 38848 - RNA, 21 nt, Homo sapiens
aaucuggagaccagaaaucca

SEQ ID NO: 38849 - RNA, 20 nt, Homo sapiens
agaaaacgaauacaggcaac

SEQ ID NO: 38850 - RNA, 21 nt, Homo sapiens
ccaccucucacgaaaacggcu

SEQ ID NO: 38851 - RNA, 18 nt, Homo sapiens
cgaaggaaggccugagaa

SEQ ID NO: 38852 - RNA, 17 nt, Homo sapiens
cuucuucuguuuugacu

SEQ ID NO: 38853 - RNA, 22 nt, Homo sapiens
gcaagagcacuggcuguuguga

SEQ ID NO: 38854 - RNA, 15 nt, Homo sapiens
ggccaugcugccucu

SEQ ID NO: 38855 - RNA, 23 nt, Homo sapiens
ucacauccugaccccgccggcga

SEQ ID NO: 38856 - RNA, 17 nt, Homo sapiens
accguuuaggcuaaaac

SEQ ID NO: 38857 - RNA, 18 nt, Homo sapiens
ccuggaauuuuuuggccc

SEQ ID NO: 38858 - RNA, 19 nt, Homo sapiens
gcgaggcuucagugagcug

SEQ ID NO: 38859 - RNA, 17 nt, Homo sapiens
ggaauaguuuccagaua

SEQ ID NO: 38860 - RNA, 19 nt, Homo sapiens
ucaaacauggguuuuguug

SEQ ID NO: 38861 - RNA, 18 nt, Homo sapiens
uccagggugaaaagggag

SEQ ID NO: 38862 - RNA, 16 nt, Homo sapiens
gaugaugguguugaag

SEQ ID NO: 38863 - RNA, 20 nt, Homo sapiens
ucuaagaucuaaaucauuuu

SEQ ID NO: 38864 - RNA, 17 nt, Homo sapiens
uguguuccggauauuuu

SEQ ID NO: 38865 - RNA, 21 nt, Homo sapiens
cagcagcagcaggagcccaug

SEQ ID NO: 38866 - RNA, 24 nt, Homo sapiens
ccgucccccuaccuugccugcuga

SEQ ID NO: 38867 - RNA, 18 nt, Homo sapiens
acuugacauccguggugu

SEQ ID NO: 38868 - RNA, 20 nt, Homo sapiens
agaagaagucauucccaaca

SEQ ID NO: 38869 - RNA, 18 nt, Homo sapiens
agacccagggugcgugcc

SEQ ID NO: 38870 - RNA, 20 nt, Homo sapiens
agggcauccuccagcucagc

SEQ ID NO: 38871 - RNA, 20 nt, Homo sapiens
caaguccugcgaugcuaagu

SEQ ID NO: 38872 - RNA, 23 nt, Homo sapiens
cauaacacaggagaccugcuccc

SEQ ID NO: 38873 - RNA, 19 nt, Homo sapiens
gaauguucucaguguccua

SEQ ID NO: 38874 - RNA, 19 nt, Homo sapiens
ggagcacucugagaucuca

SEQ ID NO: 38875 - RNA, 20 nt, Homo sapiens
ugcgauggcguucacgucca

SEQ ID NO: 38876 - RNA, 20 nt, Homo sapiens
caccgucgcucuccuaccca

SEQ ID NO: 38877 - RNA, 22 nt, Homo sapiens
ccacaguuucugucccaugaca

SEQ ID NO: 38878 - RNA, 23 nt, Homo sapiens
gccuggcgccagggacgcugcca

SEQ ID NO: 38879 - RNA, 20 nt, Homo sapiens
ucagcugccaccagcacuca

SEQ ID NO: 38880 - RNA, 20 nt, Homo sapiens
ucaugagaccgugcugcaca

SEQ ID NO: 38881 - RNA, 20 nt, Homo sapiens
ucccaggcaccuccaacaga

SEQ ID NO: 38882 - RNA, 22 nt, Homo sapiens
ugucucuuccuucacuaccuuc

SEQ ID NO: 38883 - RNA, 18 nt, Homo sapiens
agguugagcacuucagga

SEQ ID NO: 38884 - RNA, 16 nt, Homo sapiens
gaugaugguguugaag

SEQ ID NO: 38885 - RNA, 20 nt, Homo sapiens
ucuaagaucuaaaucauuuu

SEQ ID NO: 38886 - RNA, 17 nt, Homo sapiens
uguguuccggauauuuu

SEQ ID NO: 38887 - RNA, 18 nt, Homo sapiens
agguugagcacuucagga

SEQ ID NO: 38888 - RNA, 16 nt, Homo sapiens
gaugaugguguugaag

SEQ ID NO: 38889 - RNA, 20 nt, Homo sapiens
ucuaagaucuaaaucauuuu

SEQ ID NO: 38890 - RNA, 17 nt, Homo sapiens
uguguuccggauauuuu

SEQ ID NO: 38891 - RNA, 16 nt, Homo sapiens
cccccacucugccucc

SEQ ID NO: 38892 - RNA, 17 nt, Homo sapiens
ccuugcgguagccggca

SEQ ID NO: 38893 - RNA, 18 nt, Homo sapiens
cgcccccacucugccucc

SEQ ID NO: 38894 - RNA, 18 nt, Homo sapiens
gacaccccuuucuucuuc

SEQ ID NO: 38895 - RNA, 20 nt, Homo sapiens
gaugccaccuccugccacca

SEQ ID NO: 38896 - RNA, 20 nt, Homo sapiens
gcaccugccccucugccucc

SEQ ID NO: 38897 - RNA, 21 nt, Homo sapiens
ucuccugcucugcccacccuu

SEQ ID NO: 38898 - RNA, 20 nt, Homo sapiens
ugcuggcacuucuccauccu

SEQ ID NO: 38899 - RNA, 19 nt, Homo sapiens
ccugugggcuagucuccag

SEQ ID NO: 38900 - RNA, 20 nt, Homo sapiens
ugcuugaacaggccucuccu

SEQ ID NO: 38901 - RNA, 19 nt, Homo sapiens
uuaaaggcauauccugaua

SEQ ID NO: 38902 - RNA, 18 nt, Homo sapiens
uuccagaaaguuguucua

SEQ ID NO: 38903 - RNA, 20 nt, Homo sapiens
cugucuccccagcagugaca

SEQ ID NO: 38904 - RNA, 20 nt, Homo sapiens
caaguccugcgaugcuaagu

SEQ ID NO: 38905 - RNA, 20 nt, Homo sapiens
gagaaauauggauggggagc

SEQ ID NO: 38906 - RNA, 18 nt, Homo sapiens
gcaaccgacgguucccca

SEQ ID NO: 38907 - RNA, 20 nt, Homo sapiens
ugcgauggcguucacgucca

SEQ ID NO: 38908 - RNA, 19 nt, Homo sapiens
aagccccacugaugcucug

SEQ ID NO: 38909 - RNA, 17 nt, Homo sapiens
cacgaggagggccccca

SEQ ID NO: 38910 - RNA, 20 nt, Homo sapiens
gcccugcggccuccacguca

SEQ ID NO: 38911 - RNA, 21 nt, Homo sapiens
gagacugucacaggcuugcca

SEQ ID NO: 38912 - RNA, 19 nt, Homo sapiens
acgcgaguccacuuugcca

SEQ ID NO: 38913 - RNA, 21 nt, Homo sapiens
ugagcuucuguuaugaagcug

SEQ ID NO: 38914 - RNA, 18 nt, Homo sapiens
agguugagcacuucagga

SEQ ID NO: 38915 - RNA, 16 nt, Homo sapiens
gaugaugguguugaag

SEQ ID NO: 38916 - RNA, 20 nt, Homo sapiens
ucuaagaucuaaaucauuuu

SEQ ID NO: 38917 - RNA, 17 nt, Homo sapiens
uguguuccggauauuuu

SEQ ID NO: 38918 - RNA, 20 nt, Homo sapiens
aacagaacguucugagucug

SEQ ID NO: 38919 - RNA, 21 nt, Homo sapiens
uuuguugggcaaagacucuga

SEQ ID NO: 38920 - RNA, 19 nt, Homo sapiens
ccuaaggcaccuucugugg

SEQ ID NO: 38921 - RNA, 19 nt, Homo sapiens
cauccuugaagcccagaca

SEQ ID NO: 38922 - RNA, 19 nt, Homo sapiens
ccaguccucccccaccucc

SEQ ID NO: 38923 - RNA, 20 nt, Homo sapiens
gaugugagguggcuauucca

SEQ ID NO: 38924 - RNA, 17 nt, Homo sapiens
gcggcugccucugcccc

SEQ ID NO: 38925 - RNA, 17 nt, Homo sapiens
accccaaggauaugcaa

SEQ ID NO: 38926 - RNA, 23 nt, Homo sapiens
ccuaagggauaugaauuguuuuu

SEQ ID NO: 38927 - RNA, 20 nt, Homo sapiens
cgcguaagcuagggcugcaa

SEQ ID NO: 38928 - RNA, 23 nt, Homo sapiens
uaggcauuuuccagaauuccuca

SEQ ID NO: 38929 - RNA, 20 nt, Homo sapiens
aucuuuucuuucuuccagau

SEQ ID NO: 38930 - RNA, 17 nt, Homo sapiens
gagauugggggccuguc

SEQ ID NO: 38931 - RNA, 23 nt, Homo sapiens
cccugggagcaucaguguccuca

SEQ ID NO: 38932 - RNA, 25 nt, Homo sapiens
ccuccccaaaaacagauugacccag

SEQ ID NO: 38933 - RNA, 19 nt, Homo sapiens
gcuauuccuuucugcgacg

SEQ ID NO: 38934 - RNA, 21 nt, Homo sapiens
ugggacuacagauguuugcca

SEQ ID NO: 38935 - RNA, 16 nt, Homo sapiens
aagaucugccagcagc

SEQ ID NO: 38936 - RNA, 21 nt, Homo sapiens
caccaaggcuuucccaucuug

SEQ ID NO: 38937 - RNA, 19 nt, Homo sapiens
ccccucugguggacagaga

SEQ ID NO: 38938 - RNA, 20 nt, Homo sapiens
cuggcgugggaggucugggg

SEQ ID NO: 38939 - RNA, 19 nt, Homo sapiens
cuucaagacucguccuuca

SEQ ID NO: 38940 - RNA, 19 nt, Homo sapiens
gaucugccagcagccccaa

SEQ ID NO: 38941 - RNA, 23 nt, Homo sapiens
gccugcugaagcccuccuugcca

SEQ ID NO: 38942 - RNA, 19 nt, Homo sapiens
ggcgggggcccagaacuaa

SEQ ID NO: 38943 - RNA, 21 nt, Homo sapiens
uggcaggaggacagucaguga

SEQ ID NO: 38944 - RNA, 18 nt, Homo sapiens
cacuguagguggcugcaa

SEQ ID NO: 38945 - RNA, 24 nt, Homo sapiens
caugaaggaaugaauaaagaguuu

SEQ ID NO: 38946 - RNA, 19 nt, Homo sapiens
uacccgacguucucccugg

SEQ ID NO: 38947 - RNA, 18 nt, Homo sapiens
ucccacugcuugccugcu

SEQ ID NO: 38948 - RNA, 18 nt, Homo sapiens
aaggucauggcaacaguu

SEQ ID NO: 38949 - RNA, 21 nt, Homo sapiens
augaucagaacuguuguugua

SEQ ID NO: 38950 - RNA, 22 nt, Homo sapiens
ccaaggcaaccccucagggcug

SEQ ID NO: 38951 - RNA, 17 nt, Homo sapiens
guaauccuccucccucu

SEQ ID NO: 38952 - RNA, 21 nt, Homo sapiens
gugguuuuaagagagaggauc

SEQ ID NO: 38953 - RNA, 20 nt, Homo sapiens
uccugcaggacugucagcaa

SEQ ID NO: 38954 - RNA, 19 nt, Homo sapiens
uguuacucagaacacuuca

SEQ ID NO: 38955 - RNA, 18 nt, Homo sapiens
uuccaggaacuagcccag

SEQ ID NO: 38956 - RNA, 19 nt, Homo sapiens
aaacagaaacccagaaugg

SEQ ID NO: 38957 - RNA, 16 nt, Homo sapiens
acagaaaauauguucc

SEQ ID NO: 38958 - RNA, 16 nt, Homo sapiens
acuccgccuggcuuac

SEQ ID NO: 38959 - RNA, 20 nt, Homo sapiens
caucucacucacguguauca

SEQ ID NO: 38960 - RNA, 19 nt, Homo sapiens
ccagggagcuugaagagcu

SEQ ID NO: 38961 - RNA, 22 nt, Homo sapiens
ccguuguugacggagcagggaa

SEQ ID NO: 38962 - RNA, 18 nt, Homo sapiens
uccgccucccggguucaa

SEQ ID NO: 38963 - RNA, 21 nt, Homo sapiens
ucugagugguagggagucacu

SEQ ID NO: 38964 - RNA, 17 nt, Homo sapiens
gccauggcucuuggccu

SEQ ID NO: 38965 - RNA, 19 nt, Homo sapiens
ucugcugaguguaaaugga

SEQ ID NO: 38966 - RNA, 18 nt, Homo sapiens
aacauagcuucuguugac

SEQ ID NO: 38967 - RNA, 24 nt, Homo sapiens
caaauaaugaagaucucuccuuca

SEQ ID NO: 38968 - RNA, 20 nt, Homo sapiens
cucuccuucagucugcucug

SEQ ID NO: 38969 - RNA, 22 nt, Homo sapiens
uaaauggacuucaugaggaaau

SEQ ID NO: 38970 - RNA, 22 nt, Homo sapiens
uccaaaacccggacaagcucuu

SEQ ID NO: 38971 - RNA, 21 nt, Homo sapiens
acuuuuccugcugccuggccu

SEQ ID NO: 38972 - RNA, 26 nt, Homo sapiens
uuugaucaaauuugaacuucauuuug

SEQ ID NO: 38973 - RNA, 21 nt, Homo sapiens
gccuucucggccgccuggucc

SEQ ID NO: 38974 - RNA, 19 nt, Homo sapiens
aaacaaacccaaauauuaa

SEQ ID NO: 38975 - RNA, 23 nt, Homo sapiens
uccagccaaguuuguauaccuca

SEQ ID NO: 38976 - RNA, 22 nt, Homo sapiens
ugaauggaccuugacagauggc

SEQ ID NO: 38977 - RNA, 22 nt, Homo sapiens
uuccccagaaccauuuucugaa

SEQ ID NO: 38978 - RNA, 17 nt, Homo sapiens
aaguaauacaguagcug

SEQ ID NO: 38979 - RNA, 20 nt, Homo sapiens
gagacacuggacacaaccca

SEQ ID NO: 38980 - RNA, 22 nt, Homo sapiens
gagccaagaucgcaucacugca

SEQ ID NO: 38981 - RNA, 17 nt, Homo sapiens
gagggccgggauugauc

SEQ ID NO: 38982 - RNA, 16 nt, Homo sapiens
gcaucacugcauucca

SEQ ID NO: 38983 - RNA, 21 nt, Homo sapiens
uugaucaauacccgagaagua

SEQ ID NO: 38984 - RNA, 20 nt, Homo sapiens
cccucccacuaccuccuucc

SEQ ID NO: 38985 - RNA, 23 nt, Homo sapiens
uaaguuugugaaaaucuacauua

SEQ ID NO: 38986 - RNA, 20 nt, Homo sapiens
ugcaaaccauguuugccaaa

SEQ ID NO: 38987 - RNA, 24 nt, Homo sapiens
aguuaaauauugggacacuaacca

SEQ ID NO: 38988 - RNA, 18 nt, Homo sapiens
ucuucuuucucugucuca

SEQ ID NO: 38989 - RNA, 22 nt, Homo sapiens
ugaagaaaucagagggaacgca

SEQ ID NO: 38990 - RNA, 17 nt, Homo sapiens
ccacggccccgcccguu

SEQ ID NO: 38991 - RNA, 15 nt, Homo sapiens
ccguggaaucuuguu

SEQ ID NO: 38992 - RNA, 21 nt, Homo sapiens
cggggcggcccugcugccagc

SEQ ID NO: 38993 - RNA, 19 nt, Homo sapiens
ugccuuguugaaaauuuca

SEQ ID NO: 38994 - RNA, 21 nt, Homo sapiens
acuguugaggaucacucugaa

SEQ ID NO: 38995 - RNA, 20 nt, Homo sapiens
acagugggcacuauaagcca

SEQ ID NO: 38996 - RNA, 21 nt, Homo sapiens
gaaacugaacaagccaccugc

SEQ ID NO: 38997 - RNA, 28 nt, Homo sapiens
ucuccaccuucaggacaaaagcauuuca

SEQ ID NO: 38998 - RNA, 21 nt, Homo sapiens
uucagaaccauccuaacaaua

SEQ ID NO: 38999 - RNA, 18 nt, Homo sapiens
aauucuuuuucuguaccu

SEQ ID NO: 39000 - RNA, 17 nt, Homo sapiens
uauuuuguggcauaugc

SEQ ID NO: 39001 - RNA, 22 nt, Homo sapiens
ucuuguuuuuuuaucuugccca

SEQ ID NO: 39002 - RNA, 23 nt, Homo sapiens
uucuggugaguaagaccugggga

SEQ ID NO: 39003 - RNA, 24 nt, Homo sapiens
accugagcuggagccacuuggcuu

SEQ ID NO: 39004 - RNA, 21 nt, Homo sapiens
caccaccaccaucaccacgcu

SEQ ID NO: 39005 - RNA, 19 nt, Homo sapiens
ccuaccccggcuggaguag

SEQ ID NO: 39006 - RNA, 20 nt, Homo sapiens
cggcgccgcaccugcugcac

SEQ ID NO: 39007 - RNA, 22 nt, Homo sapiens
gcucgacgccgccgccuggccc

SEQ ID NO: 39008 - RNA, 22 nt, Homo sapiens
ggucaucagcagcagcuguggc

SEQ ID NO: 39009 - RNA, 18 nt, Homo sapiens
guagagcugcuggccuca

SEQ ID NO: 39010 - RNA, 19 nt, Homo sapiens
uccuccagaggccuggaag

SEQ ID NO: 39011 - RNA, 17 nt, Homo sapiens
uuugcuugcugggaggc

SEQ ID NO: 39012 - RNA, 27 nt, Homo sapiens
ccagucauggaguuaagaagugaguca

SEQ ID NO: 39013 - RNA, 23 nt, Homo sapiens
ccauacaacaggacuaugugaug

SEQ ID NO: 39014 - RNA, 21 nt, Homo sapiens
uccacagacacuacccaaagc

SEQ ID NO: 39015 - RNA, 19 nt, Homo sapiens
gcuugggcuguggcaagcu

SEQ ID NO: 39016 - RNA, 19 nt, Homo sapiens
cuaucauccaagcuuugug

SEQ ID NO: 39017 - RNA, 18 nt, Homo sapiens
agcaggggcuggggcuca

SEQ ID NO: 39018 - RNA, 17 nt, Homo sapiens
ccagguccccacuggca

SEQ ID NO: 39019 - RNA, 20 nt, Homo sapiens
gcacgugagagcggccaggg

SEQ ID NO: 39020 - RNA, 19 nt, Homo sapiens
ggccgggugcgguggcuca

SEQ ID NO: 39021 - RNA, 23 nt, Homo sapiens
uccuggugaugacaucuugagag

SEQ ID NO: 39022 - RNA, 21 nt, Homo sapiens
aaauggaagcaaacaacauca

SEQ ID NO: 39023 - RNA, 18 nt, Homo sapiens
ccccuguacuucauuuca

SEQ ID NO: 39024 - RNA, 17 nt, Homo sapiens
agagagaaggcacucuu

SEQ ID NO: 39025 - RNA, 20 nt, Homo sapiens
caaacuauaaccauauaaua

SEQ ID NO: 39026 - RNA, 19 nt, Homo sapiens
cacugaauuaauuuuuaca

SEQ ID NO: 39027 - RNA, 19 nt, Homo sapiens
uaacuccuuaaaacaguua

SEQ ID NO: 39028 - RNA, 16 nt, Homo sapiens
uggccagguguagugg

SEQ ID NO: 39029 - RNA, 21 nt, Homo sapiens
aucuuggcucgcugcaaccuc

SEQ ID NO: 39030 - RNA, 17 nt, Homo sapiens
ccucacccaacgauccc

SEQ ID NO: 39031 - RNA, 18 nt, Homo sapiens
uccgccucccagguucaa

SEQ ID NO: 39032 - RNA, 16 nt, Homo sapiens
ugaagagacugagagu

SEQ ID NO: 39033 - RNA, 19 nt, Homo sapiens
acagugucaggguuagaug

SEQ ID NO: 39034 - RNA, 21 nt, Homo sapiens
agaugggaggaggugugcgug

SEQ ID NO: 39035 - RNA, 23 nt, Homo sapiens
ccaccaccaguagccuugggcug

SEQ ID NO: 39036 - RNA, 18 nt, Homo sapiens
ccagaucuuucuaaccca

SEQ ID NO: 39037 - RNA, 19 nt, Homo sapiens
gguuaaaugacaguugcca

SEQ ID NO: 39038 - RNA, 20 nt, Homo sapiens
ucauaauucaacccaugaca

SEQ ID NO: 39039 - RNA, 19 nt, Homo sapiens
aaucauuuccauucccaua

SEQ ID NO: 39040 - RNA, 22 nt, Homo sapiens
ccuacuccuccagguuguugcu

SEQ ID NO: 39041 - RNA, 24 nt, Homo sapiens
gagagaggaaaguagacuccauca

SEQ ID NO: 39042 - RNA, 23 nt, Homo sapiens
ucauuuccauucccauaaaacuu

SEQ ID NO: 39043 - RNA, 20 nt, Homo sapiens
ugcccaggcucccaacccag

SEQ ID NO: 39044 - RNA, 20 nt, Homo sapiens
ugccuugauuaaauguauua

SEQ ID NO: 39045 - RNA, 19 nt, Homo sapiens
ugaacaaugagcacacaug

SEQ ID NO: 39046 - RNA, 24 nt, Homo sapiens
acaaaccagucaccaaauucccag

SEQ ID NO: 39047 - RNA, 20 nt, Homo sapiens
uucccaccugugaauaugua

SEQ ID NO: 39048 - RNA, 20 nt, Homo sapiens
aaaacacuccucaguaaaug

SEQ ID NO: 39049 - RNA, 19 nt, Homo sapiens
ucugaaaugaagacuccuc

SEQ ID NO: 39050 - RNA, 23 nt, Homo sapiens
aaaggggggauugugacauauca

SEQ ID NO: 39051 - RNA, 17 nt, Homo sapiens
acugggguaauugugac

SEQ ID NO: 39052 - RNA, 18 nt, Homo sapiens
gaggaacuuuccuacuca

SEQ ID NO: 39053 - RNA, 18 nt, Homo sapiens
uccugguccuguucucug

SEQ ID NO: 39054 - RNA, 17 nt, Homo sapiens
ucugcauccaucaucac

SEQ ID NO: 39055 - RNA, 19 nt, Homo sapiens
aaacaaaggcaguacaugc

SEQ ID NO: 39056 - RNA, 18 nt, Homo sapiens
aucuuaccaacggaucac

SEQ ID NO: 39057 - RNA, 22 nt, Homo sapiens
cgugaacguggacuguaaccuu

SEQ ID NO: 39058 - RNA, 19 nt, Homo sapiens
uccaacuggguguauucua

SEQ ID NO: 39059 - RNA, 22 nt, Homo sapiens
uggguguauucuaguguggaac

SEQ ID NO: 39060 - RNA, 24 nt, Homo sapiens
ccaccgccgccgcugcuaccgcca

SEQ ID NO: 39061 - RNA, 20 nt, Homo sapiens
cgcgcccgcggcccgcgcgc

SEQ ID NO: 39062 - RNA, 22 nt, Homo sapiens
ugggcuuaguuggcugggauug

SEQ ID NO: 39063 - RNA, 18 nt, Homo sapiens
agaaucaucaguauguca

SEQ ID NO: 39064 - RNA, 23 nt, Homo sapiens
uuugcucaaaaggagaccauucu

SEQ ID NO: 39065 - RNA, 22 nt, Homo sapiens
aucacucucggggccgccauuc

SEQ ID NO: 39066 - RNA, 19 nt, Homo sapiens
uccagcuucaccgaccucc

SEQ ID NO: 39067 - RNA, 18 nt, Homo sapiens
aaguucaaccacugcacu

SEQ ID NO: 39068 - RNA, 21 nt, Homo sapiens
accacugcacuccacuaagca

SEQ ID NO: 39069 - RNA, 22 nt, Homo sapiens
agauggggucagcgccugcccu

SEQ ID NO: 39070 - RNA, 21 nt, Homo sapiens
aucuccugucucuggacaaca

SEQ ID NO: 39071 - RNA, 20 nt, Homo sapiens
ccugucucuggacaacaauc

SEQ ID NO: 39072 - RNA, 18 nt, Homo sapiens
ggcguucuguuacagcag

SEQ ID NO: 39073 - RNA, 19 nt, Homo sapiens
aaguugacuuaaacauuuu

SEQ ID NO: 39074 - RNA, 18 nt, Homo sapiens
gaaguauugacuucgugg

SEQ ID NO: 39075 - RNA, 16 nt, Homo sapiens
ccaccuuuccugcuca

SEQ ID NO: 39076 - RNA, 17 nt, Homo sapiens
cuuagaaaggcuuuuaa

SEQ ID NO: 39077 - RNA, 21 nt, Homo sapiens
aaaaacgcaaauccuguucac

SEQ ID NO: 39078 - RNA, 17 nt, Homo sapiens
auacaccugucaaugcc

SEQ ID NO: 39079 - RNA, 19 nt, Homo sapiens
cacaaacaccuccaucuca

SEQ ID NO: 39080 - RNA, 19 nt, Homo sapiens
uuucuuuauaaaucaccca

SEQ ID NO: 39081 - RNA, 18 nt, Homo sapiens
aaugccagagacuguuga

SEQ ID NO: 39082 - RNA, 21 nt, Homo sapiens
aauggaaaugagguguauuua

SEQ ID NO: 39083 - RNA, 20 nt, Homo sapiens
acaaaaacaaaaacauuuua

SEQ ID NO: 39084 - RNA, 17 nt, Homo sapiens
acaucauccagauucca

SEQ ID NO: 39085 - RNA, 21 nt, Homo sapiens
agcaaguuucacaguuaaaca

SEQ ID NO: 39086 - RNA, 23 nt, Homo sapiens
ccaauuauaaacucauuacucca

SEQ ID NO: 39087 - RNA, 27 nt, Homo sapiens
cuaucuaucuauaucuucaucccauca

SEQ ID NO: 39088 - RNA, 22 nt, Homo sapiens
gagccaagaucgcgccacugca

SEQ ID NO: 39089 - RNA, 17 nt, Homo sapiens
gcguaucuaugguaaua

SEQ ID NO: 39090 - RNA, 18 nt, Homo sapiens
uuuggcaucuacauuaca

SEQ ID NO: 39091 - RNA, 17 nt, Homo sapiens
guaaaaauacagcauug

SEQ ID NO: 39092 - RNA, 18 nt, Homo sapiens
aggccccaaguuauuuuu

SEQ ID NO: 39093 - RNA, 20 nt, Homo sapiens
aagaauaaggaugaucuccu

SEQ ID NO: 39094 - RNA, 18 nt, Homo sapiens
ucuauagaauguugcaca

SEQ ID NO: 39095 - RNA, 24 nt, Homo sapiens
uuuuuuuauggcaguuuuuauuuu

SEQ ID NO: 39096 - RNA, 27 nt, Homo sapiens
ggccgucccaaaacacccauuuccucu

SEQ ID NO: 39097 - RNA, 20 nt, Homo sapiens
ugaggggcaccccagccuca

SEQ ID NO: 39098 - RNA, 19 nt, Homo sapiens
aaacaggaugaccaaauug

SEQ ID NO: 39099 - RNA, 19 nt, Homo sapiens
agacaauaaaauuguauua

SEQ ID NO: 39100 - RNA, 22 nt, Homo sapiens
gagccaagaucgugccacugca

SEQ ID NO: 39101 - RNA, 27 nt, Homo sapiens
ccagucauggagcuaagaagugaguca

SEQ ID NO: 39102 - RNA, 23 nt, Homo sapiens
ccauacaacaggacuaugugaug

SEQ ID NO: 39103 - RNA, 21 nt, Homo sapiens
uccacagacacuacccaaagc

SEQ ID NO: 39104 - RNA, 18 nt, Homo sapiens
aagauaauuuggaacagg

SEQ ID NO: 39105 - RNA, 19 nt, Homo sapiens
cugaaaacugcuuuugcug

SEQ ID NO: 39106 - RNA, 21 nt, Homo sapiens
ucagaaaaagaaaguccuuca

SEQ ID NO: 39107 - RNA, 20 nt, Homo sapiens
agcucaaguguaagauuuau

SEQ ID NO: 39108 - RNA, 23 nt, Homo sapiens
aguuuucuuuccuugcuugaagu

SEQ ID NO: 39109 - RNA, 21 nt, Homo sapiens
auccugaauggcagccaguga

SEQ ID NO: 39110 - RNA, 22 nt, Homo sapiens
gaacacuaauagccccccugga

SEQ ID NO: 39111 - RNA, 17 nt, Homo sapiens
guuuccuaacaauauca

SEQ ID NO: 39112 - RNA, 24 nt, Homo sapiens
ucaauggccuucaaauugguguua

SEQ ID NO: 39113 - RNA, 21 nt, Homo sapiens
ucugaagauaaauuaugugaa

SEQ ID NO: 39114 - RNA, 22 nt, Homo sapiens
cccacggcuucuaauagagcua

SEQ ID NO: 39115 - RNA, 19 nt, Homo sapiens
gagaacacgaggcuugcca

SEQ ID NO: 39116 - RNA, 23 nt, Homo sapiens
gcuugaauuggauuuguugguuu

SEQ ID NO: 39117 - RNA, 20 nt, Homo sapiens
aaacacauguuguauguuuu

SEQ ID NO: 39118 - RNA, 18 nt, Homo sapiens
auacuuaauauuaccucc

SEQ ID NO: 39119 - RNA, 17 nt, Homo sapiens
cucccuccucuaucucu

SEQ ID NO: 39120 - RNA, 19 nt, Homo sapiens
cuuaauauuaccuccaaug

SEQ ID NO: 39121 - RNA, 18 nt, Homo sapiens
guaacuggcacugucauu

SEQ ID NO: 39122 - RNA, 20 nt, Homo sapiens
guuuguacaguuguguguug

SEQ ID NO: 39123 - RNA, 21 nt, Homo sapiens
uuaaggacuacauacauucua

SEQ ID NO: 39124 - RNA, 25 nt, Homo sapiens
uuucuacucacaauuugaucaucac

SEQ ID NO: 39125 - RNA, 16 nt, Homo sapiens
aacaacugcuccaucu

SEQ ID NO: 39126 - RNA, 17 nt, Homo sapiens
gcaacuguucacaguga

SEQ ID NO: 39127 - RNA, 24 nt, Homo sapiens
uucugacgguuccuucucugugaa

SEQ ID NO: 39128 - RNA, 20 nt, Homo sapiens
cuggaacccuccucugccuc

SEQ ID NO: 39129 - RNA, 19 nt, Homo sapiens
cuuaaaaaagaccauuucu

SEQ ID NO: 39130 - RNA, 20 nt, Homo sapiens
uucgagaggccccguuuucc

SEQ ID NO: 39131 - RNA, 18 nt, Homo sapiens
ucaccugcgcggcacgug

SEQ ID NO: 39132 - RNA, 25 nt, Homo sapiens
caaaaacaugguuguacuuaauuuu

SEQ ID NO: 39133 - RNA, 18 nt, Homo sapiens
ggaauaaucgcaaguucc

SEQ ID NO: 39134 - RNA, 18 nt, Homo sapiens
ccagaccucuuuuucaga

SEQ ID NO: 39135 - RNA, 22 nt, Homo sapiens
cugcacaagggccaguccccaa

SEQ ID NO: 39136 - RNA, 23 nt, Homo sapiens
gggauggcccuccuggcuucagc

SEQ ID NO: 39137 - RNA, 19 nt, Homo sapiens
gucugcaucauccuggugg

SEQ ID NO: 39138 - RNA, 22 nt, Homo sapiens
ucacuuuccccucacccauccc

SEQ ID NO: 39139 - RNA, 16 nt, Homo sapiens
uuguuacagcuaugug

SEQ ID NO: 39140 - RNA, 24 nt, Homo sapiens
uaagugggucuccaaaguggggcu

SEQ ID NO: 39141 - RNA, 22 nt, Homo sapiens
auggugcaaaacaagcacugca

SEQ ID NO: 39142 - RNA, 19 nt, Homo sapiens
aauacagugaguucugcca

SEQ ID NO: 39143 - RNA, 19 nt, Homo sapiens
aucucgugaaggcuguagg

SEQ ID NO: 39144 - RNA, 18 nt, Homo sapiens
auuuucagguuaugucau

SEQ ID NO: 39145 - RNA, 16 nt, Homo sapiens
caaaaucuuuguagua

SEQ ID NO: 39146 - RNA, 16 nt, Homo sapiens
cagaaauuaagacuuu

SEQ ID NO: 39147 - RNA, 20 nt, Homo sapiens
gauaguggcaagcaccaagu

SEQ ID NO: 39148 - RNA, 20 nt, Homo sapiens
ucuuuugcaugcuuuaaucu

SEQ ID NO: 39149 - RNA, 17 nt, Homo sapiens
ugucaguaaauguagua

SEQ ID NO: 39150 - RNA, 18 nt, Homo sapiens
ugacuccuaaaugugaua

SEQ ID NO: 39151 - RNA, 17 nt, Homo sapiens
uuugcuugccuugcgca

SEQ ID NO: 39152 - RNA, 18 nt, Homo sapiens
aaauggaaccagagguua

SEQ ID NO: 39153 - RNA, 16 nt, Homo sapiens
aaaauucauccugcug

SEQ ID NO: 39154 - RNA, 19 nt, Homo sapiens
caaaaacauaguuucugca

SEQ ID NO: 39155 - RNA, 20 nt, Homo sapiens
cuucuguguuagccaucuua

SEQ ID NO: 39156 - RNA, 18 nt, Homo sapiens
guuucccuacuucuguga

SEQ ID NO: 39157 - RNA, 25 nt, Homo sapiens
uccaaaggguccucauucuguuccu

SEQ ID NO: 39158 - RNA, 19 nt, Homo sapiens
ucugaguccugauuggcuu

SEQ ID NO: 39159 - RNA, 19 nt, Homo sapiens
uguuggcguaauuuuugaa

SEQ ID NO: 39160 - RNA, 17 nt, Homo sapiens
uuuauuucauugaauua

SEQ ID NO: 39161 - RNA, 16 nt, Homo sapiens
aucaccaccaccgggu

SEQ ID NO: 39162 - RNA, 21 nt, Homo sapiens
ccaccgggucugccucagcca

SEQ ID NO: 39163 - RNA, 17 nt, Homo sapiens
caaggggagcuggaagc

SEQ ID NO: 39164 - RNA, 20 nt, Homo sapiens
gaaacaggaacagccagugg

SEQ ID NO: 39165 - RNA, 19 nt, Homo sapiens
cuaaagcaguuaguuguga

SEQ ID NO: 39166 - RNA, 19 nt, Homo sapiens
uccgccuccugagguucaa

SEQ ID NO: 39167 - RNA, 18 nt, Homo sapiens
uuuauacagcauguugua

SEQ ID NO: 39168 - RNA, 19 nt, Homo sapiens
cccggcaggccggugcaca

SEQ ID NO: 39169 - RNA, 19 nt, Homo sapiens
cuucuuuguagccccagcc

SEQ ID NO: 39170 - RNA, 19 nt, Homo sapiens
ccgagguguacccacagug

SEQ ID NO: 39171 - RNA, 19 nt, Homo sapiens
uaaguccaugagggauguc

SEQ ID NO: 39172 - RNA, 20 nt, Homo sapiens
uccagccccuccaccccucc

SEQ ID NO: 39173 - RNA, 23 nt, Homo sapiens
gcuucucuguugcgcuugccccu

SEQ ID NO: 39174 - RNA, 25 nt, Homo sapiens
ugcccugacuccgauggugaaacug

SEQ ID NO: 39175 - RNA, 27 nt, Homo sapiens
cucugauaaugugucgugugguuugug

SEQ ID NO: 39176 - RNA, 19 nt, Homo sapiens
agcaagucaccuuccuucu

SEQ ID NO: 39177 - RNA, 18 nt, Homo sapiens
caagaugugguggguuuu

SEQ ID NO: 39178 - RNA, 22 nt, Homo sapiens
cguacccuucugccucccccuc

SEQ ID NO: 39179 - RNA, 18 nt, Homo sapiens
cucagcuuugugcucuga

SEQ ID NO: 39180 - RNA, 19 nt, Homo sapiens
cuccguacccuucugccuc

SEQ ID NO: 39181 - RNA, 22 nt, Homo sapiens
gagccaagaucgcaccauuaca

SEQ ID NO: 39182 - RNA, 17 nt, Homo sapiens
ggacuauuuccaugaca

SEQ ID NO: 39183 - RNA, 18 nt, Homo sapiens
ggguguuggacacagcuu

SEQ ID NO: 39184 - RNA, 19 nt, Homo sapiens
uagguuuucaucuacuuua

SEQ ID NO: 39185 - RNA, 21 nt, Homo sapiens
uccauucagaagacaacauuu

SEQ ID NO: 39186 - RNA, 25 nt, Homo sapiens
ucuuggcaauuaggggauuugggaa

SEQ ID NO: 39187 - RNA, 19 nt, Homo sapiens
ugaguguuaaauauggagc

SEQ ID NO: 39188 - RNA, 21 nt, Homo sapiens
uugaucucuccuauaaucagu

SEQ ID NO: 39189 - RNA, 22 nt, Homo sapiens
uaggcgugagacaccgcgccug

SEQ ID NO: 39190 - RNA, 22 nt, Homo sapiens
aacgauagauuugaaacaagcu

SEQ ID NO: 39191 - RNA, 18 nt, Homo sapiens
uuagagccugacaccucu

SEQ ID NO: 39192 - RNA, 22 nt, Homo sapiens
uuuugggacauggccacugcuu

SEQ ID NO: 39193 - RNA, 17 nt, Homo sapiens
cauaagaaaacuuaucu

SEQ ID NO: 39194 - RNA, 18 nt, Homo sapiens
ccgggcaggucacugugc

SEQ ID NO: 39195 - RNA, 22 nt, Homo sapiens
gaggucgagaucagccugggaa

SEQ ID NO: 39196 - RNA, 16 nt, Homo sapiens
ggaagacucauuccaa

SEQ ID NO: 39197 - RNA, 19 nt, Homo sapiens
gguggaagagcaaaacuca

SEQ ID NO: 39198 - RNA, 19 nt, Homo sapiens
acaugccuaucuagcagca

SEQ ID NO: 39199 - RNA, 23 nt, Homo sapiens
ccuaaggaguccagauuguuuuu

SEQ ID NO: 39200 - RNA, 21 nt, Homo sapiens
gcugcugaauuuaaauaguaa

SEQ ID NO: 39201 - RNA, 23 nt, Homo sapiens
aaauaauuuugucccaagucuua

SEQ ID NO: 39202 - RNA, 18 nt, Homo sapiens
caugcuuugcacucuccu

SEQ ID NO: 39203 - RNA, 21 nt, Homo sapiens
ggcaaagaugagaacuuccca

SEQ ID NO: 39204 - RNA, 21 nt, Homo sapiens
uuaaggacuguauaauucauu

SEQ ID NO: 39205 - RNA, 18 nt, Homo sapiens
acugcuucucugcucuga

SEQ ID NO: 39206 - RNA, 21 nt, Homo sapiens
ccccaguugaggcucagauga

SEQ ID NO: 39207 - RNA, 20 nt, Homo sapiens
gaacugaguggacucugcca

SEQ ID NO: 39208 - RNA, 21 nt, Homo sapiens
ggagcaaaacggggcuguggc

SEQ ID NO: 39209 - RNA, 18 nt, Homo sapiens
uccagggaaguuaaugga

SEQ ID NO: 39210 - RNA, 21 nt, Homo sapiens
uucugccucaaccaugagaua

SEQ ID NO: 39211 - RNA, 19 nt, Homo sapiens
cuugacuuaagacuuggaa

SEQ ID NO: 39212 - RNA, 17 nt, Homo sapiens
gcgccggcugcuggcca

SEQ ID NO: 39213 - RNA, 17 nt, Homo sapiens
ggccucaaaaaauauua

SEQ ID NO: 39214 - RNA, 18 nt, Homo sapiens
acacagucuccacaguuu

SEQ ID NO: 39215 - RNA, 23 nt, Homo sapiens
accacuagacuucagugcaggga

SEQ ID NO: 39216 - RNA, 19 nt, Homo sapiens
agaagaggccuggaugcac

SEQ ID NO: 39217 - RNA, 20 nt, Homo sapiens
auacagagguaaaagaauug

SEQ ID NO: 39218 - RNA, 16 nt, Homo sapiens
cacgugcacagaugcc

SEQ ID NO: 39219 - RNA, 18 nt, Homo sapiens
cagcugacaaaucaucuc

SEQ ID NO: 39220 - RNA, 20 nt, Homo sapiens
ggaucagggcaaaacaacuu

SEQ ID NO: 39221 - RNA, 16 nt, Homo sapiens
uucagagaggauaaau

SEQ ID NO: 39222 - RNA, 24 nt, Homo sapiens
cgcgagcccugccggccggacuuu

SEQ ID NO: 39223 - RNA, 23 nt, Homo sapiens
uaaauuaauucaacaugaaguug

SEQ ID NO: 39224 - RNA, 18 nt, Homo sapiens
aauaagcaauccuaugau

SEQ ID NO: 39225 - RNA, 20 nt, Homo sapiens
uugccuaaaacaguagcuuu

SEQ ID NO: 39226 - RNA, 20 nt, Homo sapiens
aaaagaaaacaguaaaugaa

SEQ ID NO: 39227 - RNA, 22 nt, Homo sapiens
agcaucaggauuccaggaggau

SEQ ID NO: 39228 - RNA, 20 nt, Homo sapiens
ucaacauggaguccaaguaa

SEQ ID NO: 39229 - RNA, 27 nt, Homo sapiens
aggcacagcacuuacaagggugugaag

SEQ ID NO: 39230 - RNA, 20 nt, Homo sapiens
caagcacagggcccuccuca

SEQ ID NO: 39231 - RNA, 17 nt, Homo sapiens
gggagggcagggcugga

SEQ ID NO: 39232 - RNA, 18 nt, Homo sapiens
gguaacugucggcaaugu

SEQ ID NO: 39233 - RNA, 17 nt, Homo sapiens
uacagacagacguccug

SEQ ID NO: 39234 - RNA, 19 nt, Homo sapiens
uaccauaagcacccugcac

SEQ ID NO: 39235 - RNA, 23 nt, Homo sapiens
uccugcucacagccuggcacaga

SEQ ID NO: 39236 - RNA, 23 nt, Homo sapiens
ucuggacuuuccuuucuguuccu

SEQ ID NO: 39237 - RNA, 19 nt, Homo sapiens
aaacacauaucaagaucca

SEQ ID NO: 39238 - RNA, 19 nt, Homo sapiens
agucauuuccacagccuca

SEQ ID NO: 39239 - RNA, 22 nt, Homo sapiens
gaggccacaagaagaaaacuga

SEQ ID NO: 39240 - RNA, 19 nt, Homo sapiens
gcgccacggcagacacacc

SEQ ID NO: 39241 - RNA, 22 nt, Homo sapiens
uugcccaaguauuuugugcuuu

SEQ ID NO: 39242 - RNA, 18 nt, Homo sapiens
gaacuuugaacgauccca

SEQ ID NO: 39243 - RNA, 18 nt, Homo sapiens
ugaccuuccugggccuca

SEQ ID NO: 39244 - RNA, 21 nt, Homo sapiens
uguuuaauucuagauauaggg

SEQ ID NO: 39245 - RNA, 23 nt, Homo sapiens
agcuucuggaggaaugcauguca

SEQ ID NO: 39246 - RNA, 18 nt, Homo sapiens
caggaauacagguuuucu

SEQ ID NO: 39247 - RNA, 22 nt, Homo sapiens
gcuggcugcauuccaccauagc

SEQ ID NO: 39248 - RNA, 17 nt, Homo sapiens
agcucuuuggccccuga

SEQ ID NO: 39249 - RNA, 22 nt, Homo sapiens
agucucacuuugucacccaggc

SEQ ID NO: 39250 - RNA, 20 nt, Homo sapiens
ccuguauuggaaaucuugca

SEQ ID NO: 39251 - RNA, 19 nt, Homo sapiens
cugcaagcucugccucuca

SEQ ID NO: 39252 - RNA, 17 nt, Homo sapiens
ucaagugauucuccugc

SEQ ID NO: 39253 - RNA, 21 nt, Homo sapiens
uguuaguguuuuuuaauggag

SEQ ID NO: 39254 - RNA, 18 nt, Homo sapiens
caagcuuugcaacaauga

SEQ ID NO: 39255 - RNA, 24 nt, Homo sapiens
acuccaggcucuaaccuggagcug

SEQ ID NO: 39256 - RNA, 19 nt, Homo sapiens
cauaaccaugaguauauca

SEQ ID NO: 39257 - RNA, 18 nt, Homo sapiens
gugucuuccuggacuccg

SEQ ID NO: 39258 - RNA, 22 nt, Homo sapiens
ucagcugccgucauccacacca

SEQ ID NO: 39259 - RNA, 19 nt, Homo sapiens
aagcaauucuccugccuca

SEQ ID NO: 39260 - RNA, 18 nt, Homo sapiens
accagcauugcuuggcuu

SEQ ID NO: 39261 - RNA, 18 nt, Homo sapiens
agugaucauuccaccuca

SEQ ID NO: 39262 - RNA, 15 nt, Homo sapiens
gcaaaacauguuuuu

SEQ ID NO: 39263 - RNA, 18 nt, Homo sapiens
guccauuuuuuaaucagg

SEQ ID NO: 39264 - RNA, 18 nt, Homo sapiens
uccgccucccagguucaa

SEQ ID NO: 39265 - RNA, 19 nt, Homo sapiens
accagaaauccucugaaga

SEQ ID NO: 39266 - RNA, 21 nt, Homo sapiens
gacagaaguuccugguucucc

SEQ ID NO: 39267 - RNA, 23 nt, Homo sapiens
gggugcaccagaugacaggacca

SEQ ID NO: 39268 - RNA, 20 nt, Homo sapiens
ugguucuccagcaggaacug

SEQ ID NO: 39269 - RNA, 19 nt, Homo sapiens
agcucuucuuuguucaucu

SEQ ID NO: 39270 - RNA, 19 nt, Homo sapiens
caguggugcagcgguccau

SEQ ID NO: 39271 - RNA, 20 nt, Homo sapiens
gcagaguugacggauuaucc

SEQ ID NO: 39272 - RNA, 22 nt, Homo sapiens
ugacccugcagugugcaggcga

SEQ ID NO: 39273 - RNA, 17 nt, Homo sapiens
ugaccaaauccugugua

SEQ ID NO: 39274 - RNA, 18 nt, Homo sapiens
ucguggaauaacuguucc

SEQ ID NO: 39275 - RNA, 20 nt, Homo sapiens
caaaaacacagcaaguggga

SEQ ID NO: 39276 - RNA, 22 nt, Homo sapiens
gaggcugucauccagccugaga

SEQ ID NO: 39277 - RNA, 21 nt, Homo sapiens
gccugagagguuucuuggcuc

SEQ ID NO: 39278 - RNA, 20 nt, Homo sapiens
cccagagaaauucaccauga

SEQ ID NO: 39279 - RNA, 22 nt, Homo sapiens
ccucucccagacugugaccuua

SEQ ID NO: 39280 - RNA, 18 nt, Homo sapiens
aagcugaagcacgcccca

SEQ ID NO: 39281 - RNA, 17 nt, Homo sapiens
ggagcucccggaaucuc

SEQ ID NO: 39282 - RNA, 22 nt, Homo sapiens
aaaagcuuuaaacuucugcagu

SEQ ID NO: 39283 - RNA, 16 nt, Homo sapiens
ccccaggaggcucagu

SEQ ID NO: 39284 - RNA, 24 nt, Homo sapiens
cuuugaaaauggcuguuuuaccuu

SEQ ID NO: 39285 - RNA, 19 nt, Homo sapiens
gcauuaguuaaaucccuua

SEQ ID NO: 39286 - RNA, 20 nt, Homo sapiens
gugcaacaguaguaggauau

SEQ ID NO: 39287 - RNA, 17 nt, Homo sapiens
cagguggagcccugcuc

SEQ ID NO: 39288 - RNA, 18 nt, Homo sapiens
cuacauguuucuuuuuca

SEQ ID NO: 39289 - RNA, 19 nt, Homo sapiens
guuugacuuuaaaguugca

SEQ ID NO: 39290 - RNA, 18 nt, Homo sapiens
uccugaaggcgacagucu

SEQ ID NO: 39291 - RNA, 18 nt, Homo sapiens
acagaaaauaauauuccu

SEQ ID NO: 39292 - RNA, 20 nt, Homo sapiens
acucacuucaauucuaugaa

SEQ ID NO: 39293 - RNA, 18 nt, Homo sapiens
agauagugauuccucuga

SEQ ID NO: 39294 - RNA, 19 nt, Homo sapiens
gguucaagacuucagugga

SEQ ID NO: 39295 - RNA, 23 nt, Homo sapiens
guucauuauuaucacaccuguua

SEQ ID NO: 39296 - RNA, 20 nt, Homo sapiens
uaaguugaagccaauaugaa

SEQ ID NO: 39297 - RNA, 21 nt, Homo sapiens
uaucaacauuaauaguacuuu

SEQ ID NO: 39298 - RNA, 21 nt, Homo sapiens
uccauagauagugauuccucu

SEQ ID NO: 39299 - RNA, 20 nt, Homo sapiens
gccuucuggaagguaggcuu

SEQ ID NO: 39300 - RNA, 19 nt, Homo sapiens
ugaauguguuguuugguuc

SEQ ID NO: 39301 - RNA, 18 nt, Homo sapiens
aaauauuucaauguaaua

SEQ ID NO: 39302 - RNA, 21 nt, Homo sapiens
aggccucggugauucagccac

SEQ ID NO: 39303 - RNA, 23 nt, Homo sapiens
auucucaccaaaauagauggugu

SEQ ID NO: 39304 - RNA, 19 nt, Homo sapiens
agucgcugagaagcugcug

SEQ ID NO: 39305 - RNA, 21 nt, Homo sapiens
ccuccgcccaaguugaagucu

SEQ ID NO: 39306 - RNA, 23 nt, Homo sapiens
cucuuccgcucucugcacugcuu

SEQ ID NO: 39307 - RNA, 21 nt, Homo sapiens
gcucucugcacugcuucucga

SEQ ID NO: 39308 - RNA, 18 nt, Homo sapiens
uuuucacuucuggaccgc

SEQ ID NO: 39309 - RNA, 18 nt, Homo sapiens
aaaggaaggaggguauca

SEQ ID NO: 39310 - RNA, 18 nt, Homo sapiens
aaaggaaggaggguauca

SEQ ID NO: 39311 - RNA, 19 nt, Homo sapiens
aauaacugugcacugagcu

SEQ ID NO: 39312 - RNA, 21 nt, Homo sapiens
agguuaagaacaugcccagga

SEQ ID NO: 39313 - RNA, 16 nt, Homo sapiens
auguuucuacucagac

SEQ ID NO: 39314 - RNA, 18 nt, Homo sapiens
cuauggggcccagugcca

SEQ ID NO: 39315 - RNA, 20 nt, Homo sapiens
cucuggcauuuggggucugc

SEQ ID NO: 39316 - RNA, 19 nt, Homo sapiens
cugcccagaggucuaagag

SEQ ID NO: 39317 - RNA, 24 nt, Homo sapiens
gcacugagcuccaauuuuguucca

SEQ ID NO: 39318 - RNA, 18 nt, Homo sapiens
gguuaagaacaugcccag

SEQ ID NO: 39319 - RNA, 19 nt, Homo sapiens
gucuccuccuuguucucca

SEQ ID NO: 39320 - RNA, 19 nt, Homo sapiens
cugcaaccucuaccuccca

SEQ ID NO: 39321 - RNA, 18 nt, Homo sapiens
ucuaccucccagguucaa

SEQ ID NO: 39322 - RNA, 22 nt, Homo sapiens
ugagacuacaggcacgcaccac

SEQ ID NO: 39323 - RNA, 23 nt, Homo sapiens
gccaagugaggcgguucugggga

SEQ ID NO: 39324 - RNA, 19 nt, Homo sapiens
ggccuucgcgcuccgggug

SEQ ID NO: 39325 - RNA, 22 nt, Homo sapiens
gggcugugaagagaaaacucac

SEQ ID NO: 39326 - RNA, 19 nt, Homo sapiens
uggagguugaugugagcug

SEQ ID NO: 39327 - RNA, 19 nt, Homo sapiens
uccuucuugucugugacug

SEQ ID NO: 39328 - RNA, 19 nt, Homo sapiens
uguacacaaccuguacaac

SEQ ID NO: 39329 - RNA, 22 nt, Homo sapiens
aucucggcuuacuccaaccucu

SEQ ID NO: 39330 - RNA, 22 nt, Homo sapiens
caguggcacauuacaaacagua

SEQ ID NO: 39331 - RNA, 20 nt, Homo sapiens
ccucugccucccagguucaa

SEQ ID NO: 39332 - RNA, 22 nt, Homo sapiens
cucuuccuuuucaggaccuuga

SEQ ID NO: 39333 - RNA, 19 nt, Homo sapiens
gucaccacaaaguauaaga

SEQ ID NO: 39334 - RNA, 20 nt, Homo sapiens
uaguuucuuuuuuuguuguu

SEQ ID NO: 39335 - RNA, 18 nt, Homo sapiens
uaugugcaccacgaguga

SEQ ID NO: 39336 - RNA, 17 nt, Homo sapiens
ucaagugauucuuaugc

SEQ ID NO: 39337 - RNA, 21 nt, Homo sapiens
ucuguaaacuaaaaaccaggu

SEQ ID NO: 39338 - RNA, 19 nt, Homo sapiens
uguuaugcuacauacauua

SEQ ID NO: 39339 - RNA, 20 nt, Homo sapiens
agacuucucccucuccaucu

SEQ ID NO: 39340 - RNA, 22 nt, Homo sapiens
auuuuuuuccagacuucccuaa

SEQ ID NO: 39341 - RNA, 24 nt, Homo sapiens
cuuaggcagcuauggguuucuuuu

SEQ ID NO: 39342 - RNA, 17 nt, Homo sapiens
gcuuugacugcuugcuu

SEQ ID NO: 39343 - RNA, 21 nt, Homo sapiens
aaaagauccagucugugguau

SEQ ID NO: 39344 - RNA, 20 nt, Homo sapiens
guaagcucccggugaauuuu

SEQ ID NO: 39345 - RNA, 19 nt, Homo sapiens
gugggagacuuaacuuuag

SEQ ID NO: 39346 - RNA, 18 nt, Homo sapiens
ucugucuuucuuuauacc

SEQ ID NO: 39347 - RNA, 18 nt, Homo sapiens
acucauaauuuccugaca

SEQ ID NO: 39348 - RNA, 21 nt, Homo sapiens
auaauuuccugacaugggcca

SEQ ID NO: 39349 - RNA, 18 nt, Homo sapiens
augggccacucuaagugg

SEQ ID NO: 39350 - RNA, 23 nt, Homo sapiens
gcccccagcugacugccuggcuu

SEQ ID NO: 39351 - RNA, 18 nt, Homo sapiens
uguccgacgccugcccca

SEQ ID NO: 39352 - RNA, 17 nt, Homo sapiens
acuccuuuuuacccaua

SEQ ID NO: 39353 - RNA, 22 nt, Homo sapiens
aucaaagauauuuauuuccuca

SEQ ID NO: 39354 - RNA, 23 nt, Homo sapiens
ccuugauggcgauaaucugugag

SEQ ID NO: 39355 - RNA, 19 nt, Homo sapiens
cuucccaauggccauguca

SEQ ID NO: 39356 - RNA, 20 nt, Homo sapiens
aaauagugguaugcaugugu

SEQ ID NO: 39357 - RNA, 20 nt, Homo sapiens
cccacauuuaaagaccuagu

SEQ ID NO: 39358 - RNA, 17 nt, Homo sapiens
ggaucaggccugugaac

SEQ ID NO: 39359 - RNA, 17 nt, Homo sapiens
gugaauuaaucaguuuu

SEQ ID NO: 39360 - RNA, 22 nt, Homo sapiens
gauuuuccuugucaccuuuaag

SEQ ID NO: 39361 - RNA, 16 nt, Homo sapiens
ccagaauggcucucca

SEQ ID NO: 39362 - RNA, 16 nt, Homo sapiens
gacgguaaaaugugaa

SEQ ID NO: 39363 - RNA, 22 nt, Homo sapiens
uggcucuccaacuuacauuuca

SEQ ID NO: 39364 - RNA, 22 nt, Homo sapiens
gaacaggugcgacuucugagaa

SEQ ID NO: 39365 - RNA, 19 nt, Homo sapiens
ugcgaugagucagccucca

SEQ ID NO: 39366 - RNA, 22 nt, Homo sapiens
aaaaugauucuguagaagaccu

SEQ ID NO: 39367 - RNA, 18 nt, Homo sapiens
uaaaacaaaaacaauuua

SEQ ID NO: 39368 - RNA, 19 nt, Homo sapiens
ucacuuguauauggcacac

SEQ ID NO: 39369 - RNA, 24 nt, Homo sapiens
uuagcuuauuguaguauacuucca

SEQ ID NO: 39370 - RNA, 21 nt, Homo sapiens
gcugcaguggccccugcguua

SEQ ID NO: 39371 - RNA, 19 nt, Homo sapiens
accaguaucugacuguggc

SEQ ID NO: 39372 - RNA, 22 nt, Homo sapiens
augcccagcuuucucaccccag

SEQ ID NO: 39373 - RNA, 18 nt, Homo sapiens
ccaugcccagcuuucuca

SEQ ID NO: 39374 - RNA, 20 nt, Homo sapiens
ccaugaaggagcaccuuauc

SEQ ID NO: 39375 - RNA, 24 nt, Homo sapiens
uauccguguauguauauauacaca

SEQ ID NO: 39376 - RNA, 21 nt, Homo sapiens
ucggaaaauuaagcgacccaa

SEQ ID NO: 39377 - RNA, 19 nt, Homo sapiens
uggcugaaagccuguggac

SEQ ID NO: 39378 - RNA, 18 nt, Homo sapiens
gauagagcacuggacaaa

SEQ ID NO: 39379 - RNA, 25 nt, Homo sapiens
cgcgcgccgccgccccgcgcugcug

SEQ ID NO: 39380 - RNA, 19 nt, Homo sapiens
gaaaaguccacaauuuccc

SEQ ID NO: 39381 - RNA, 19 nt, Homo sapiens
ccugaacgccaccuggccc

SEQ ID NO: 39382 - RNA, 23 nt, Homo sapiens
cgcgcgccgccugugugcugcug

SEQ ID NO: 39383 - RNA, 15 nt, Homo sapiens
gcuucacgcugcagu

SEQ ID NO: 39384 - RNA, 22 nt, Homo sapiens
ugcucauguuggccuuucucga

SEQ ID NO: 39385 - RNA, 20 nt, Homo sapiens
aaggcaugacuaguauuucu

SEQ ID NO: 39386 - RNA, 20 nt, Homo sapiens
aauacuguaggaagucagug

SEQ ID NO: 39387 - RNA, 20 nt, Homo sapiens
acagacagugaaccugacug

SEQ ID NO: 39388 - RNA, 21 nt, Homo sapiens
auguggagcaaauggaauggu

SEQ ID NO: 39389 - RNA, 18 nt, Homo sapiens
caacccaugacugcuccu

SEQ ID NO: 39390 - RNA, 21 nt, Homo sapiens
caaggggagcccuggaagcug

SEQ ID NO: 39391 - RNA, 19 nt, Homo sapiens
cagauggggauuuuuguca

SEQ ID NO: 39392 - RNA, 18 nt, Homo sapiens
gaaaauggcccagauucu

SEQ ID NO: 39393 - RNA, 16 nt, Homo sapiens
gagaggucagaagugg

SEQ ID NO: 39394 - RNA, 20 nt, Homo sapiens
uaagugcaauaauaugaaau

SEQ ID NO: 39395 - RNA, 18 nt, Homo sapiens
ucauuuccaucuucccac

SEQ ID NO: 39396 - RNA, 17 nt, Homo sapiens
ucccaucaggccucugu

SEQ ID NO: 39397 - RNA, 21 nt, Homo sapiens
ucuaaguauuggaucucuuuu

SEQ ID NO: 39398 - RNA, 27 nt, Homo sapiens
ugaaugggcagcugaugguuggaguug

SEQ ID NO: 39399 - RNA, 20 nt, Homo sapiens
uucaagacuggucaguccaa

SEQ ID NO: 39400 - RNA, 22 nt, Homo sapiens
aaaagcaggcucaucgaauaca

SEQ ID NO: 39401 - RNA, 25 nt, Homo sapiens
cucugauguucagugaagaguacca

SEQ ID NO: 39402 - RNA, 21 nt, Homo sapiens
caccaggacuaaaggccgcca

SEQ ID NO: 39403 - RNA, 22 nt, Homo sapiens
cagccuggcuaacacagugaaa

SEQ ID NO: 39404 - RNA, 21 nt, Homo sapiens
caggacucaucugccauuuca

SEQ ID NO: 39405 - RNA, 25 nt, Homo sapiens
gccaccggggaacggggaucgguga

SEQ ID NO: 39406 - RNA, 17 nt, Homo sapiens
gcgccggccgagaccug

SEQ ID NO: 39407 - RNA, 18 nt, Homo sapiens
ccagaaacaaauacccaa

SEQ ID NO: 39408 - RNA, 20 nt, Homo sapiens
cuacggucaccugugugguu

SEQ ID NO: 39409 - RNA, 22 nt, Homo sapiens
ucuagcccuaguuugcuccuga

SEQ ID NO: 39410 - RNA, 20 nt, Homo sapiens
aauaggcagaggcuggaaca

SEQ ID NO: 39411 - RNA, 18 nt, Homo sapiens
ccauuugcaacaggaaca

SEQ ID NO: 39412 - RNA, 28 nt, Homo sapiens
uauaauuggcaacaggaacauuuaccca

SEQ ID NO: 39413 - RNA, 19 nt, Homo sapiens
uggaugugagacauggaau

SEQ ID NO: 39414 - RNA, 18 nt, Homo sapiens
cccgccgccugcguucuc

SEQ ID NO: 39415 - RNA, 23 nt, Homo sapiens
cccugcaucagaaugccugcgaa

SEQ ID NO: 39416 - RNA, 19 nt, Homo sapiens
cugcaagcuccgccuccca

SEQ ID NO: 39417 - RNA, 23 nt, Homo sapiens
gccugggcuuccaggccugguuc

SEQ ID NO: 39418 - RNA, 16 nt, Homo sapiens
gucucacgggggcucu

SEQ ID NO: 39419 - RNA, 20 nt, Homo sapiens
uggaagccagaguggggcug

SEQ ID NO: 39420 - RNA, 20 nt, Homo sapiens
cccacagucccgagacuggg

SEQ ID NO: 39421 - RNA, 21 nt, Homo sapiens
ccccagggggcccccugcggc

SEQ ID NO: 39422 - RNA, 17 nt, Homo sapiens
gccccgccccucccccu

SEQ ID NO: 39423 - RNA, 18 nt, Homo sapiens
ggcgacggcggcgguggc

SEQ ID NO: 39424 - RNA, 20 nt, Homo sapiens
ggggauguagaggcggcggc

SEQ ID NO: 39425 - RNA, 21 nt, Homo sapiens
uaguugcuuuuuguuguuuuu

SEQ ID NO: 39426 - RNA, 23 nt, Homo sapiens
agggcauucaugaaagaacaacu

SEQ ID NO: 39427 - RNA, 18 nt, Homo sapiens
cuuuccagagcuacccag

SEQ ID NO: 39428 - RNA, 19 nt, Homo sapiens
uuaaaaaucuaagaugugg

SEQ ID NO: 39429 - RNA, 17 nt, Homo sapiens
augaaguugucuguaca

SEQ ID NO: 39430 - RNA, 23 nt, Homo sapiens
ucaaagucauuuuugacacauca

SEQ ID NO: 39431 - RNA, 18 nt, Homo sapiens
uccacccugcagguucaa

SEQ ID NO: 39432 - RNA, 16 nt, Homo sapiens
ucucaguucacugcaa

SEQ ID NO: 39433 - RNA, 23 nt, Homo sapiens
uuagaaaaugugaaacuguucuu

SEQ ID NO: 39434 - RNA, 18 nt, Homo sapiens
accugggcugcgacgugg

SEQ ID NO: 39435 - RNA, 18 nt, Homo sapiens
acugacaacacacuaggc

SEQ ID NO: 39436 - RNA, 19 nt, Homo sapiens
agcuuuaagguguuacccu

SEQ ID NO: 39437 - RNA, 17 nt, Homo sapiens
uacugacacugucagcu

SEQ ID NO: 39438 - RNA, 19 nt, Homo sapiens
cagcuggcaccagcaucua

SEQ ID NO: 39439 - RNA, 20 nt, Homo sapiens
cccagaagaaugguguccca

SEQ ID NO: 39440 - RNA, 17 nt, Homo sapiens
gaauggauuaauggaac

SEQ ID NO: 39441 - RNA, 22 nt, Homo sapiens
ucuggagugcagugguacaaua

SEQ ID NO: 39442 - RNA, 21 nt, Homo sapiens
aaacccugcuacuacuccucu

SEQ ID NO: 39443 - RNA, 23 nt, Homo sapiens
aacagcucaaauccauuuuuuac

SEQ ID NO: 39444 - RNA, 20 nt, Homo sapiens
acacuuguaaguucacaggu

SEQ ID NO: 39445 - RNA, 22 nt, Homo sapiens
auccaaacaccuugcugaccaa

SEQ ID NO: 39446 - RNA, 22 nt, Homo sapiens
cucagaacacaagauccaguca

SEQ ID NO: 39447 - RNA, 24 nt, Homo sapiens
cuccugaaaaagugcugccuccug

SEQ ID NO: 39448 - RNA, 21 nt, Homo sapiens
ugaaggaaacacuaauuccuc

SEQ ID NO: 39449 - RNA, 24 nt, Homo sapiens
uugccaucaccggugaacagcuca

SEQ ID NO: 39450 - RNA, 24 nt, Homo sapiens
acauaaugcucagugaaaauagca

SEQ ID NO: 39451 - RNA, 18 nt, Homo sapiens
auauuuucauugccccca

SEQ ID NO: 39452 - RNA, 27 nt, Homo sapiens
auuuggaucagauuggcuguuaggcuu

SEQ ID NO: 39453 - RNA, 21 nt, Homo sapiens
cauuuuauaguaucacugcua

SEQ ID NO: 39454 - RNA, 17 nt, Homo sapiens
gcaagucaacugccaug

SEQ ID NO: 39455 - RNA, 24 nt, Homo sapiens
gcaccuacagaggaauccauacca

SEQ ID NO: 39456 - RNA, 20 nt, Homo sapiens
ugcuuaguucauaguaugcu

SEQ ID NO: 39457 - RNA, 18 nt, Homo sapiens
uguaaauuaaacaugaau

SEQ ID NO: 39458 - RNA, 18 nt, Homo sapiens
ccgagcgcgcacgcucug

SEQ ID NO: 39459 - RNA, 18 nt, Homo sapiens
cugccuggcuccugcccc

SEQ ID NO: 39460 - RNA, 18 nt, Homo sapiens
uggggugguguuguuaua

SEQ ID NO: 39461 - RNA, 24 nt, Homo sapiens
uuuaaguguagcagcuuugacuuu

SEQ ID NO: 39462 - RNA, 20 nt, Homo sapiens
aagugaaagaagccagccau

SEQ ID NO: 39463 - RNA, 22 nt, Homo sapiens
ggcagaaacaacuccagagcca

SEQ ID NO: 39464 - RNA, 23 nt, Homo sapiens
uggcccaaaagagacaaguaaca

SEQ ID NO: 39465 - RNA, 18 nt, Homo sapiens
uuccauuacuguguuugc

SEQ ID NO: 39466 - RNA, 20 nt, Homo sapiens
acgaucacggacagguaugc

SEQ ID NO: 39467 - RNA, 18 nt, Homo sapiens
acucugcaccuccuucca

SEQ ID NO: 39468 - RNA, 19 nt, Homo sapiens
augggagcccccauaccca

SEQ ID NO: 39469 - RNA, 25 nt, Homo sapiens
cuucugacaccuugacuuuagccuu

SEQ ID NO: 39470 - RNA, 20 nt, Homo sapiens
uucaagaccagccuagccaa

SEQ ID NO: 39471 - RNA, 16 nt, Homo sapiens
ccguaaugcucacaac

SEQ ID NO: 39472 - RNA, 19 nt, Homo sapiens
ccguaaugcucacaacaac

SEQ ID NO: 39473 - RNA, 20 nt, Homo sapiens
gccccucgauccuaaccuca

SEQ ID NO: 39474 - RNA, 17 nt, Homo sapiens
cacguggugaggcugca

SEQ ID NO: 39475 - RNA, 19 nt, Homo sapiens
ccucuguccccuuggaagu

SEQ ID NO: 39476 - RNA, 18 nt, Homo sapiens
gguggccuggacaaucca

SEQ ID NO: 39477 - RNA, 18 nt, Homo sapiens
cccacaaccuccgccucc

SEQ ID NO: 39478 - RNA, 18 nt, Homo sapiens
uccgccucccagguucaa

SEQ ID NO: 39479 - RNA, 21 nt, Homo sapiens
aucuccaguuguuaaagcuca

SEQ ID NO: 39480 - RNA, 19 nt, Homo sapiens
ucuguuggugaucucauaa

SEQ ID NO: 39481 - RNA, 21 nt, Homo sapiens
ugcacuucuuuacucugguaa

SEQ ID NO: 39482 - RNA, 16 nt, Homo sapiens
uuucuuccuuauauua

SEQ ID NO: 39483 - RNA, 21 nt, Homo sapiens
caccaaagcucaucccucucc

SEQ ID NO: 39484 - RNA, 23 nt, Homo sapiens
cucuuucucuccaccaaagcuca

SEQ ID NO: 39485 - RNA, 17 nt, Homo sapiens
aauacgugggcuugacu

SEQ ID NO: 39486 - RNA, 25 nt, Homo sapiens
accaacuagcuuuaguagugcugcu

SEQ ID NO: 39487 - RNA, 22 nt, Homo sapiens
agagaaacccugaacaaagcug

SEQ ID NO: 39488 - RNA, 20 nt, Homo sapiens
ugaagagacauuguucagag

SEQ ID NO: 39489 - RNA, 21 nt, Homo sapiens
acauagccgccagaccucuuc

SEQ ID NO: 39490 - RNA, 19 nt, Homo sapiens
ccaggggcugcccugcugu

SEQ ID NO: 39491 - RNA, 17 nt, Homo sapiens
gcuggugucgacggagu

SEQ ID NO: 39492 - RNA, 17 nt, Homo sapiens
ccaauggugcugcaugg

SEQ ID NO: 39493 - RNA, 20 nt, Homo sapiens
aggaagggcugggugagaca

SEQ ID NO: 39494 - RNA, 22 nt, Homo sapiens
caccuuuuggagauuuaaccau

SEQ ID NO: 39495 - RNA, 20 nt, Homo sapiens
cagaagaaggguugggucug

SEQ ID NO: 39496 - RNA, 18 nt, Homo sapiens
ccaccuuuuggagauuua

SEQ ID NO: 39497 - RNA, 17 nt, Homo sapiens
cuaucucauguguuaga

SEQ ID NO: 39498 - RNA, 19 nt, Homo sapiens
cuuguuugcucaaaugcaa

SEQ ID NO: 39499 - RNA, 22 nt, Homo sapiens
gcuugcggccugcaggcacucc

SEQ ID NO: 39500 - RNA, 23 nt, Homo sapiens
uacugcauuuccuucuugcucug

SEQ ID NO: 39501 - RNA, 23 nt, Homo sapiens
uggagcauggcagggcuugguua

SEQ ID NO: 39502 - RNA, 19 nt, Homo sapiens
agaauguagaaaagccauu

SEQ ID NO: 39503 - RNA, 18 nt, Homo sapiens
aggauuuuacuguguugg

SEQ ID NO: 39504 - RNA, 16 nt, Homo sapiens
ccacaaauaugaagaa

SEQ ID NO: 39505 - RNA, 20 nt, Homo sapiens
ccucugccuuccagguucaa

SEQ ID NO: 39506 - RNA, 21 nt, Homo sapiens
ugaaaugauccauacaccucu

SEQ ID NO: 39507 - RNA, 16 nt, Homo sapiens
ccacaaauaugaagaa

SEQ ID NO: 39508 - RNA, 16 nt, Homo sapiens
cguccucuuacuccua

SEQ ID NO: 39509 - RNA, 19 nt, Homo sapiens
uggagcaaaaccuuacaaa

SEQ ID NO: 39510 - RNA, 20 nt, Homo sapiens
agccccuccagauuggcacu

SEQ ID NO: 39511 - RNA, 24 nt, Homo sapiens
cagguuuguuuguuucccacuuuu

SEQ ID NO: 39512 - RNA, 21 nt, Homo sapiens
cgauccuuuuuaacacucuca

SEQ ID NO: 39513 - RNA, 18 nt, Homo sapiens
cuguagggacacuguguu

SEQ ID NO: 39514 - RNA, 19 nt, Homo sapiens
gaaagccacagaggauggg

SEQ ID NO: 39515 - RNA, 22 nt, Homo sapiens
gcccauagacuacaguucuuca

SEQ ID NO: 39516 - RNA, 15 nt, Homo sapiens
gucugaucuguggac

SEQ ID NO: 39517 - RNA, 19 nt, Homo sapiens
uucagaucuuuguaccuua

SEQ ID NO: 39518 - RNA, 19 nt, Homo sapiens
augggagcccccauaccca

SEQ ID NO: 39519 - RNA, 25 nt, Homo sapiens
ccucugacaccuugacuuuagccuu

SEQ ID NO: 39520 - RNA, 20 nt, Homo sapiens
uucaagaccagccuagccaa

SEQ ID NO: 39521 - RNA, 18 nt, Homo sapiens
ggcacagcuccucccuca

SEQ ID NO: 39522 - RNA, 21 nt, Homo sapiens
aagcaagugcauaaccuucuc

SEQ ID NO: 39523 - RNA, 19 nt, Homo sapiens
ccaucuucacccccaccuc

SEQ ID NO: 39524 - RNA, 23 nt, Homo sapiens
ccuccccggcucaucacucccca

SEQ ID NO: 39525 - RNA, 20 nt, Homo sapiens
cugaagagauugccugguuc

SEQ ID NO: 39526 - RNA, 22 nt, Homo sapiens
gagccaagaucaugccacugca

SEQ ID NO: 39527 - RNA, 18 nt, Homo sapiens
ggagccuccauuuuucuc

SEQ ID NO: 39528 - RNA, 17 nt, Homo sapiens
ccuccgggagccugggu

SEQ ID NO: 39529 - RNA, 21 nt, Homo sapiens
cuuaaaaaacuguccauuuaa

SEQ ID NO: 39530 - RNA, 17 nt, Homo sapiens
gggccgcccgcucccuc

SEQ ID NO: 39531 - RNA, 18 nt, Homo sapiens
guuuccaucaacaccgcu

SEQ ID NO: 39532 - RNA, 20 nt, Homo sapiens
ugagacuacaguggggcuga

SEQ ID NO: 39533 - RNA, 20 nt, Homo sapiens
augagucuuggagguucuga

SEQ ID NO: 39534 - RNA, 18 nt, Homo sapiens
uuucaagacagugguguu

SEQ ID NO: 39535 - RNA, 19 nt, Homo sapiens
caugaguggggaagagcaa

SEQ ID NO: 39536 - RNA, 21 nt, Homo sapiens
gagagcccgcccggccugaga

SEQ ID NO: 39537 - RNA, 21 nt, Homo sapiens
gagcgccuccagccccauagc

SEQ ID NO: 39538 - RNA, 21 nt, Homo sapiens
uguuaaaauaaaaccuaacca

SEQ ID NO: 39539 - RNA, 25 nt, Homo sapiens
ggccauuuuacuuaaaucuguauua

SEQ ID NO: 39540 - RNA, 21 nt, Homo sapiens
ggcucccgccuguaaucccau

SEQ ID NO: 39541 - RNA, 19 nt, Homo sapiens
ccuacacucccucucugag

SEQ ID NO: 39542 - RNA, 17 nt, Homo sapiens
agaagaaccuggaccau

SEQ ID NO: 39543 - RNA, 24 nt, Homo sapiens
cagaaaaaaacauaauucugguga

SEQ ID NO: 39544 - RNA, 20 nt, Homo sapiens
cuggaccauucuugauggag

SEQ ID NO: 39545 - RNA, 18 nt, Homo sapiens
cuuuucauccuaaaucuu

SEQ ID NO: 39546 - RNA, 20 nt, Homo sapiens
ucuguauuauuauaugugcu

SEQ ID NO: 39547 - RNA, 22 nt, Homo sapiens
gggugcccccgaugggaggcug

SEQ ID NO: 39548 - RNA, 19 nt, Homo sapiens
gugugugugugucuggcug

SEQ ID NO: 39549 - RNA, 25 nt, Homo sapiens
guucuccuccacaucucccauccca

SEQ ID NO: 39550 - RNA, 22 nt, Homo sapiens
aaccaggauuugcucgaucuca

SEQ ID NO: 39551 - RNA, 19 nt, Homo sapiens
acaggccagaaaccagcag

SEQ ID NO: 39552 - RNA, 20 nt, Homo sapiens
agcagccacaggagauguca

SEQ ID NO: 39553 - RNA, 20 nt, Homo sapiens
aguguccagugcccaucucu

SEQ ID NO: 39554 - RNA, 21 nt, Homo sapiens
caggacccgccccacccugcg

SEQ ID NO: 39555 - RNA, 20 nt, Homo sapiens
cagguccccaaaugaucuua

SEQ ID NO: 39556 - RNA, 20 nt, Homo sapiens
cccgccccacccugcgguuc

SEQ ID NO: 39557 - RNA, 20 nt, Homo sapiens
gaggaggcucugcaugucca

SEQ ID NO: 39558 - RNA, 21 nt, Homo sapiens
gcagcaaagcuguaucugcua

SEQ ID NO: 39559 - RNA, 20 nt, Homo sapiens
gcugucuccccagcgugucc

SEQ ID NO: 39560 - RNA, 23 nt, Homo sapiens
ucccguggcucggauucucugag

SEQ ID NO: 39561 - RNA, 21 nt, Homo sapiens
ugagugaccugacugagacua

SEQ ID NO: 39562 - RNA, 20 nt, Homo sapiens
aggagggcgaguggcgagca

SEQ ID NO: 39563 - RNA, 23 nt, Homo sapiens
acagagaagaggagaccccaaca

SEQ ID NO: 39564 - RNA, 19 nt, Homo sapiens
uucuggaucccagcagugu

SEQ ID NO: 39565 - RNA, 21 nt, Homo sapiens
acagcugcguuggagugguga

SEQ ID NO: 39566 - RNA, 19 nt, Homo sapiens
accaaaacaaacugaagag

SEQ ID NO: 39567 - RNA, 22 nt, Homo sapiens
accacucaguacccacugggca

SEQ ID NO: 39568 - RNA, 22 nt, Homo sapiens
acggauccuguuugggccuuca

SEQ ID NO: 39569 - RNA, 18 nt, Homo sapiens
cagcagauucugcuucuu

SEQ ID NO: 39570 - RNA, 19 nt, Homo sapiens
ccuggcagcccucuggccu

SEQ ID NO: 39571 - RNA, 20 nt, Homo sapiens
acuuuuccacauaccccaca

SEQ ID NO: 39572 - RNA, 18 nt, Homo sapiens
caacagagucauuuccua

SEQ ID NO: 39573 - RNA, 21 nt, Homo sapiens
ccaucccagggcauugugacc

SEQ ID NO: 39574 - RNA, 20 nt, Homo sapiens
ccuucaucuccuuacucucg

SEQ ID NO: 39575 - RNA, 23 nt, Homo sapiens
gaaagaccuuuuggaccaccccu

SEQ ID NO: 39576 - RNA, 16 nt, Homo sapiens
ugcaaccuccaccccc

SEQ ID NO: 39577 - RNA, 21 nt, Homo sapiens
ugggccugguacauggcaaug

SEQ ID NO: 39578 - RNA, 18 nt, Homo sapiens
uggugguaaaggauguac

SEQ ID NO: 39579 - RNA, 23 nt, Homo sapiens
ucaggagugagccuggcacucca

SEQ ID NO: 39580 - RNA, 19 nt, Homo sapiens
caugaaacggcuuucccgg

SEQ ID NO: 39581 - RNA, 21 nt, Homo sapiens
ccuguucaccccucugaccgc

SEQ ID NO: 39582 - RNA, 18 nt, Homo sapiens
cuugccccuggucagcgu

SEQ ID NO: 39583 - RNA, 24 nt, Homo sapiens
aucuggauugugcagagccugccu

SEQ ID NO: 39584 - RNA, 23 nt, Homo sapiens
uucugguacaagaugccugugga

SEQ ID NO: 39585 - RNA, 23 nt, Homo sapiens
ucaugacuuuuuuauguguacca

SEQ ID NO: 39586 - RNA, 22 nt, Homo sapiens
acaaugggagcaacccuuugca

SEQ ID NO: 39587 - RNA, 21 nt, Homo sapiens
caugccuguguggguaucuga

SEQ ID NO: 39588 - RNA, 17 nt, Homo sapiens
ccagcagccccugcccc

SEQ ID NO: 39589 - RNA, 22 nt, Homo sapiens
ccccacccgcaccccugcaccu

SEQ ID NO: 39590 - RNA, 16 nt, Homo sapiens
ccccugcaccugccac

SEQ ID NO: 39591 - RNA, 16 nt, Homo sapiens
ccccugcaccugccac

SEQ ID NO: 39592 - RNA, 16 nt, Homo sapiens
ccccugcaccugccac

SEQ ID NO: 39593 - RNA, 18 nt, Homo sapiens
cucugccccugcgccccu

SEQ ID NO: 39594 - RNA, 18 nt, Homo sapiens
cugagcauuacucugaua

SEQ ID NO: 39595 - RNA, 19 nt, Homo sapiens
cugcgccccuccugccucu

SEQ ID NO: 39596 - RNA, 25 nt, Homo sapiens
gaacgccuucuucaggcccugucuu

SEQ ID NO: 39597 - RNA, 24 nt, Homo sapiens
gcccauggaggccuuuucuaaucc

SEQ ID NO: 39598 - RNA, 24 nt, Homo sapiens
gccccggaaccagaggucugggga

SEQ ID NO: 39599 - RNA, 17 nt, Homo sapiens
ugaccagcccuccugcc

SEQ ID NO: 39600 - RNA, 18 nt, Homo sapiens
ggaaacacagccagcuca

SEQ ID NO: 39601 - RNA, 20 nt, Homo sapiens
ucagcaggaagcaagauggg

SEQ ID NO: 39602 - RNA, 22 nt, Homo sapiens
uggauggacucuuaucuagaau

SEQ ID NO: 39603 - RNA, 24 nt, Homo sapiens
aaaggagcucaacagcguuacuua

SEQ ID NO: 39604 - RNA, 19 nt, Homo sapiens
augaaggaaagggacacaa

SEQ ID NO: 39605 - RNA, 22 nt, Homo sapiens
gaaagaacuguaaaagucugca

SEQ ID NO: 39606 - RNA, 19 nt, Homo sapiens
guaugaggucaggagcagg

SEQ ID NO: 39607 - RNA, 18 nt, Homo sapiens
uauccaaguguccagcaa

SEQ ID NO: 39608 - RNA, 21 nt, Homo sapiens
accuggaccgcuccauuuggu

SEQ ID NO: 39609 - RNA, 20 nt, Homo sapiens
auccgugugcacacguguga

SEQ ID NO: 39610 - RNA, 21 nt, Homo sapiens
ugagucugccaaguggaacug

SEQ ID NO: 39611 - RNA, 20 nt, Homo sapiens
ggcuuugaagaacuuugcca

SEQ ID NO: 39612 - RNA, 18 nt, Homo sapiens
ggaaaaauaauucugaua

SEQ ID NO: 39613 - RNA, 21 nt, Homo sapiens
uaaucgcaaacuuccucccuu

SEQ ID NO: 39614 - RNA, 18 nt, Homo sapiens
cuaauacaaacaggaacu

SEQ ID NO: 39615 - RNA, 19 nt, Homo sapiens
cuugcaggaaggcugugag

SEQ ID NO: 39616 - RNA, 22 nt, Homo sapiens
gcuugggcucuggguuugaccc

SEQ ID NO: 39617 - RNA, 20 nt, Homo sapiens
ucuacucuaugcucugugaa

SEQ ID NO: 39618 - RNA, 18 nt, Homo sapiens
aaugagguguccgaguga

SEQ ID NO: 39619 - RNA, 16 nt, Homo sapiens
caccacugccaucaca

SEQ ID NO: 39620 - RNA, 18 nt, Homo sapiens
ggcauauuuuuuacuuca

SEQ ID NO: 39621 - RNA, 20 nt, Homo sapiens
uaugcaccacugccaucaca

SEQ ID NO: 39622 - RNA, 16 nt, Homo sapiens
uuuaguaucuucucuc

SEQ ID NO: 39623 - RNA, 19 nt, Homo sapiens
cccuguccggggaccugug

SEQ ID NO: 39624 - RNA, 22 nt, Homo sapiens
aaucauuccccaacuuguagca

SEQ ID NO: 39625 - RNA, 20 nt, Homo sapiens
ccuuuaaugccuaaaacucc

SEQ ID NO: 39626 - RNA, 25 nt, Homo sapiens
uccugacaucacugagaucugagga

SEQ ID NO: 39627 - RNA, 21 nt, Homo sapiens
ugcagacugcacauucggaca

SEQ ID NO: 39628 - RNA, 18 nt, Homo sapiens
uugcaaaaacacugccuc

SEQ ID NO: 39629 - RNA, 20 nt, Homo sapiens
uuuggacauggcagaaacca

SEQ ID NO: 39630 - RNA, 18 nt, Homo sapiens
acuccaaacuugcucuuc

SEQ ID NO: 39631 - RNA, 19 nt, Homo sapiens
agcagucccugggcaccca

SEQ ID NO: 39632 - RNA, 19 nt, Homo sapiens
caggcucaucauccaucca

SEQ ID NO: 39633 - RNA, 22 nt, Homo sapiens
ccaucuacaaauucagacucuu

SEQ ID NO: 39634 - RNA, 19 nt, Homo sapiens
gccugcugaagggaagcca

SEQ ID NO: 39635 - RNA, 23 nt, Homo sapiens
ucucuuuccagugucuuagacuu

SEQ ID NO: 39636 - RNA, 23 nt, Homo sapiens
ugcccagcagucccugggcaccc

SEQ ID NO: 39637 - RNA, 21 nt, Homo sapiens
acaucacucuuauguaauccc

SEQ ID NO: 39638 - RNA, 19 nt, Homo sapiens
caagauaguaguauuauua

SEQ ID NO: 39639 - RNA, 22 nt, Homo sapiens
ucuaagcauuuacccuuuugau

SEQ ID NO: 39640 - RNA, 20 nt, Homo sapiens
uuuugauaugcaucaagugg

SEQ ID NO: 39641 - RNA, 18 nt, Homo sapiens
cacuaauuauuuuuuaca

SEQ ID NO: 39642 - RNA, 22 nt, Homo sapiens
caggcugguaaucccaaauuga

SEQ ID NO: 39643 - RNA, 20 nt, Homo sapiens
cuauucuauuuccucaucuc

SEQ ID NO: 39644 - RNA, 16 nt, Homo sapiens
cucagugauggucuaa

SEQ ID NO: 39645 - RNA, 19 nt, Homo sapiens
gaucugaaaaggcuacaca

SEQ ID NO: 39646 - RNA, 21 nt, Homo sapiens
uacucuuaccuguaggaucca

SEQ ID NO: 39647 - RNA, 19 nt, Homo sapiens
uuccaacucuguaacacug

SEQ ID NO: 39648 - RNA, 21 nt, Homo sapiens
cgaggcgguuaccccgccgca

SEQ ID NO: 39649 - RNA, 20 nt, Homo sapiens
uaaguggguuaaauugagac

SEQ ID NO: 39650 - RNA, 20 nt, Homo sapiens
uuucuuauuugccucuuaaa

SEQ ID NO: 39651 - RNA, 18 nt, Homo sapiens
acgcaaacucuccaccga

SEQ ID NO: 39652 - RNA, 20 nt, Homo sapiens
aucuccaaagagccucuuca

SEQ ID NO: 39653 - RNA, 19 nt, Homo sapiens
caugacucagcaacauuga

SEQ ID NO: 39654 - RNA, 18 nt, Homo sapiens
gcuguugcuguccucuaa

SEQ ID NO: 39655 - RNA, 17 nt, Homo sapiens
ggagaccuggguuccca

SEQ ID NO: 39656 - RNA, 22 nt, Homo sapiens
ucugagcuauuuugcucgguuu

SEQ ID NO: 39657 - RNA, 20 nt, Homo sapiens
ucuggggucauacggcaugg

SEQ ID NO: 39658 - RNA, 18 nt, Homo sapiens
ugccauaaacauccuuga

SEQ ID NO: 39659 - RNA, 21 nt, Homo sapiens
uguaaauucuggcgugugcug

SEQ ID NO: 39660 - RNA, 19 nt, Homo sapiens
ccugagucaugauuggcuc

SEQ ID NO: 39661 - RNA, 22 nt, Homo sapiens
gcugguucucacaccagcagca

SEQ ID NO: 39662 - RNA, 19 nt, Homo sapiens
ggccaagcaacgagcacuu

SEQ ID NO: 39663 - RNA, 18 nt, Homo sapiens
ucuggugugcuuccaggu

SEQ ID NO: 39664 - RNA, 23 nt, Homo sapiens
agauucugauuuauauguuccca

SEQ ID NO: 39665 - RNA, 21 nt, Homo sapiens
caccguguccagccuugcaaa

SEQ ID NO: 39666 - RNA, 18 nt, Homo sapiens
ccuaggagcaguguuuca

SEQ ID NO: 39667 - RNA, 20 nt, Homo sapiens
ucacuccucauuauuugugc

SEQ ID NO: 39668 - RNA, 22 nt, Homo sapiens
uugucauuggagaauuucuggu

SEQ ID NO: 39669 - RNA, 22 nt, Homo sapiens
caccaaccagacaccaaacuuc

SEQ ID NO: 39670 - RNA, 24 nt, Homo sapiens
uucugaugagacugagacuuugaa

SEQ ID NO: 39671 - RNA, 22 nt, Homo sapiens
acccagagagaaaaagcauccc

SEQ ID NO: 39672 - RNA, 18 nt, Homo sapiens
ccuggcugcagccugcgg

SEQ ID NO: 39673 - RNA, 19 nt, Homo sapiens
cuuccccuccccuucccca

SEQ ID NO: 39674 - RNA, 22 nt, Homo sapiens
aaagaaauguugacaccaguga

SEQ ID NO: 39675 - RNA, 16 nt, Homo sapiens
aggaacacagguccuu

SEQ ID NO: 39676 - RNA, 23 nt, Homo sapiens
cuuaucauguaaugacagauuca

SEQ ID NO: 39677 - RNA, 16 nt, Homo sapiens
gguggauggugugucg

SEQ ID NO: 39678 - RNA, 21 nt, Homo sapiens
caauccuuuuucuguaccuca

SEQ ID NO: 39679 - RNA, 21 nt, Homo sapiens
uccaauccuuuuucuguaccu

SEQ ID NO: 39680 - RNA, 19 nt, Homo sapiens
agcugugggcaagagguca

SEQ ID NO: 39681 - RNA, 23 nt, Homo sapiens
agugccugacccugaccuguccu

SEQ ID NO: 39682 - RNA, 22 nt, Homo sapiens
ccccaccccacccagccgugua

SEQ ID NO: 39683 - RNA, 17 nt, Homo sapiens
cucuccugcccugccuu

SEQ ID NO: 39684 - RNA, 16 nt, Homo sapiens
agaccccauccccuca

SEQ ID NO: 39685 - RNA, 22 nt, Homo sapiens
gcugcaccucugcaguccccaa

SEQ ID NO: 39686 - RNA, 22 nt, Homo sapiens
cgggcgcaucacgaggucagga

SEQ ID NO: 39687 - RNA, 20 nt, Homo sapiens
uaaggguugacaccauucuc

SEQ ID NO: 39688 - RNA, 19 nt, Homo sapiens
auaaugguuuucugucuac

SEQ ID NO: 39689 - RNA, 21 nt, Homo sapiens
aucuuccaaaagacuauuaca

SEQ ID NO: 39690 - RNA, 18 nt, Homo sapiens
auucuaagcauucauacc

SEQ ID NO: 39691 - RNA, 18 nt, Homo sapiens
ccuccggaguaacuggca

SEQ ID NO: 39692 - RNA, 20 nt, Homo sapiens
cuuuuuuguauguugaccuu

SEQ ID NO: 39693 - RNA, 17 nt, Homo sapiens
gaguaacuggcauuaca

SEQ ID NO: 39694 - RNA, 19 nt, Homo sapiens
ggagauccauugaaacuca

SEQ ID NO: 39695 - RNA, 20 nt, Homo sapiens
ucauaaaaucuuauagucaa

SEQ ID NO: 39696 - RNA, 18 nt, Homo sapiens
ugagccaaaugcacuagu

SEQ ID NO: 39697 - RNA, 21 nt, Homo sapiens
uuccaaaagacuauuacaaua

SEQ ID NO: 39698 - RNA, 25 nt, Homo sapiens
uuuaaugcuuucuugaauaauuuuu

SEQ ID NO: 39699 - RNA, 19 nt, Homo sapiens
gauacaaaugcaggaauug

SEQ ID NO: 39700 - RNA, 20 nt, Homo sapiens
gugccaucagaaagcuguau

SEQ ID NO: 39701 - RNA, 18 nt, Homo sapiens
acagcggcuucuguuggc

SEQ ID NO: 39702 - RNA, 21 nt, Homo sapiens
aucuggugcaaagcucuguga

SEQ ID NO: 39703 - RNA, 22 nt, Homo sapiens
cuucaguccggcugacguggca

SEQ ID NO: 39704 - RNA, 21 nt, Homo sapiens
cuuuuucaacuuccuuagucu

SEQ ID NO: 39705 - RNA, 21 nt, Homo sapiens
gcaccagggccaaucugcuca

SEQ ID NO: 39706 - RNA, 18 nt, Homo sapiens
ggcuucuguuggcuccua

SEQ ID NO: 39707 - RNA, 20 nt, Homo sapiens
uggugcuugcugugagacug

SEQ ID NO: 39708 - RNA, 22 nt, Homo sapiens
cagacgagaccacugugagcca

SEQ ID NO: 39709 - RNA, 23 nt, Homo sapiens
cgcacacugugccucccuccuca

SEQ ID NO: 39710 - RNA, 18 nt, Homo sapiens
gaauuagcacagauccuu

SEQ ID NO: 39711 - RNA, 23 nt, Homo sapiens
uugaaaauuaauuccaccauccu

SEQ ID NO: 39712 - RNA, 21 nt, Homo sapiens
accacaggccaaggccacuuu

SEQ ID NO: 39713 - RNA, 18 nt, Homo sapiens
cuacagcuggcuccgaga

SEQ ID NO: 39714 - RNA, 16 nt, Homo sapiens
cuggacccccaaggcu

SEQ ID NO: 39715 - RNA, 17 nt, Homo sapiens
gagugggucugaggcug

SEQ ID NO: 39716 - RNA, 24 nt, Homo sapiens
gcgucgugggucuggacgaccuca

SEQ ID NO: 39717 - RNA, 24 nt, Homo sapiens
gcuccgagacagggcaggggccgc

SEQ ID NO: 39718 - RNA, 18 nt, Homo sapiens
ggagcuuccaccuucuca

SEQ ID NO: 39719 - RNA, 19 nt, Homo sapiens
gugcagcugcugcugggca

SEQ ID NO: 39720 - RNA, 21 nt, Homo sapiens
ucuugccugcggggaccugug

SEQ ID NO: 39721 - RNA, 24 nt, Homo sapiens
agucauaagacagaacauuuggca

SEQ ID NO: 39722 - RNA, 22 nt, Homo sapiens
ccuguaaaaguuuuauaaauca

SEQ ID NO: 39723 - RNA, 17 nt, Homo sapiens
gguagcacacaggacca

SEQ ID NO: 39724 - RNA, 21 nt, Homo sapiens
uaagccuuucaacagcagcau

SEQ ID NO: 39725 - RNA, 17 nt, Homo sapiens
uaucaggaagcccagug

SEQ ID NO: 39726 - RNA, 17 nt, Homo sapiens
ucuuguuauaguuguau

SEQ ID NO: 39727 - RNA, 22 nt, Homo sapiens
uuuuuuggugcuguaguauaug

SEQ ID NO: 39728 - RNA, 18 nt, Homo sapiens
gcggccucaaaguucuga

SEQ ID NO: 39729 - RNA, 17 nt, Homo sapiens
gggcgguuccugaagug

SEQ ID NO: 39730 - RNA, 21 nt, Homo sapiens
cucuccaggcuuccuugcaca

SEQ ID NO: 39731 - RNA, 21 nt, Homo sapiens
aacaggggcacacugacaccu

SEQ ID NO: 39732 - RNA, 22 nt, Homo sapiens
acaagacuauaucccacaccug

SEQ ID NO: 39733 - RNA, 21 nt, Homo sapiens
agccaaacucgccgggccucc

SEQ ID NO: 39734 - RNA, 21 nt, Homo sapiens
gcagguggccccguccuucca

SEQ ID NO: 39735 - RNA, 17 nt, Homo sapiens
agaaccugcauugcuuc

SEQ ID NO: 39736 - RNA, 20 nt, Homo sapiens
agaguggcacauccuacuga

SEQ ID NO: 39737 - RNA, 20 nt, Homo sapiens
aguaagaagggauucucauc

SEQ ID NO: 39738 - RNA, 21 nt, Homo sapiens
ccacaaagucagcauuuaaau

SEQ ID NO: 39739 - RNA, 23 nt, Homo sapiens
ccuuggcaccucagauucugugg

SEQ ID NO: 39740 - RNA, 18 nt, Homo sapiens
cucaaaggccuugcagcc

SEQ ID NO: 39741 - RNA, 20 nt, Homo sapiens
cucuauugaagacaucugau

SEQ ID NO: 39742 - RNA, 20 nt, Homo sapiens
ggaaacauguaaagccacau

SEQ ID NO: 39743 - RNA, 21 nt, Homo sapiens
gguuuuggugcaguugcacaa

SEQ ID NO: 39744 - RNA, 19 nt, Homo sapiens
aagacgccggugcugcuca

SEQ ID NO: 39745 - RNA, 21 nt, Homo sapiens
acagagccaucaucauguucc

SEQ ID NO: 39746 - RNA, 25 nt, Homo sapiens
accugaacuguggcugauuuggucc

SEQ ID NO: 39747 - RNA, 19 nt, Homo sapiens
aggaggacugggcuuagca

SEQ ID NO: 39748 - RNA, 26 nt, Homo sapiens
auggaucgcgacucuguguggggcua

SEQ ID NO: 39749 - RNA, 18 nt, Homo sapiens
cacacacugacaacuacc

SEQ ID NO: 39750 - RNA, 23 nt, Homo sapiens
cacacccgcaccauguacuccca

SEQ ID NO: 39751 - RNA, 22 nt, Homo sapiens
cauguguugugggaaggaccca

SEQ ID NO: 39752 - RNA, 18 nt, Homo sapiens
cucuguguggggcuacga

SEQ ID NO: 39753 - RNA, 22 nt, Homo sapiens
cuggugauagugaauagaucuc

SEQ ID NO: 39754 - RNA, 17 nt, Homo sapiens
ggaucagaagacaggaa

SEQ ID NO: 39755 - RNA, 21 nt, Homo sapiens
uaaaugagaggacaugagauu

SEQ ID NO: 39756 - RNA, 18 nt, Homo sapiens
uccaaauaucaccuuaaa

SEQ ID NO: 39757 - RNA, 20 nt, Homo sapiens
aaagccuuggagauccccca

SEQ ID NO: 39758 - RNA, 20 nt, Homo sapiens
gagacacuggacacaaccca

SEQ ID NO: 39759 - RNA, 21 nt, Homo sapiens
uugaucaauaccggagaagua

SEQ ID NO: 39760 - RNA, 18 nt, Homo sapiens
uugcaucacugcauucca

SEQ ID NO: 39761 - RNA, 24 nt, Homo sapiens
cagguguggggcugggcaugguca

SEQ ID NO: 39762 - RNA, 18 nt, Homo sapiens
ccuauggaauggcauucu

SEQ ID NO: 39763 - RNA, 23 nt, Homo sapiens
guuuuaucaugcccgaauagagu

SEQ ID NO: 39764 - RNA, 18 nt, Homo sapiens
uuuuaggaauuuuucuua

SEQ ID NO: 39765 - RNA, 21 nt, Homo sapiens
ccaaauucggcaagccaucca

SEQ ID NO: 39766 - RNA, 17 nt, Homo sapiens
cuuuccaccucccuccu

SEQ ID NO: 39767 - RNA, 22 nt, Homo sapiens
ugaagucucuuguaacauucca

SEQ ID NO: 39768 - RNA, 21 nt, Homo sapiens
uugcaggagggcaagccccuu

SEQ ID NO: 39769 - RNA, 16 nt, Homo sapiens
acacuuagugagaagg

SEQ ID NO: 39770 - RNA, 22 nt, Homo sapiens
accagggcagaccccacuaagc

SEQ ID NO: 39771 - RNA, 17 nt, Homo sapiens
agcaggaccuugucaug

SEQ ID NO: 39772 - RNA, 22 nt, Homo sapiens
aguugcccuggccgcccaguga

SEQ ID NO: 39773 - RNA, 18 nt, Homo sapiens
cagcaggaccuugucaug

SEQ ID NO: 39774 - RNA, 17 nt, Homo sapiens
ccaccgccuccccuuuc

SEQ ID NO: 39775 - RNA, 17 nt, Homo sapiens
ccccuggaggccacgcc

SEQ ID NO: 39776 - RNA, 19 nt, Homo sapiens
ccguggaagccucugccuc

SEQ ID NO: 39777 - RNA, 18 nt, Homo sapiens
cgcagagcauggucagga

SEQ ID NO: 39778 - RNA, 18 nt, Homo sapiens
cuaacgugucugugugau

SEQ ID NO: 39779 - RNA, 16 nt, Homo sapiens
cugagacgugcuggcc

SEQ ID NO: 39780 - RNA, 19 nt, Homo sapiens
gacgcccaccggcucccuc

SEQ ID NO: 39781 - RNA, 18 nt, Homo sapiens
gcccugguugugagauug

SEQ ID NO: 39782 - RNA, 23 nt, Homo sapiens
gccggucaccaggccacugugca

SEQ ID NO: 39783 - RNA, 24 nt, Homo sapiens
gcugccucacucuguggugucagg

SEQ ID NO: 39784 - RNA, 19 nt, Homo sapiens
ggaccuugucaugggacug

SEQ ID NO: 39785 - RNA, 20 nt, Homo sapiens
guuacggacuucccggccgc

SEQ ID NO: 39786 - RNA, 20 nt, Homo sapiens
uccaaaaaccucacucacca

SEQ ID NO: 39787 - RNA, 17 nt, Homo sapiens
ucugaaaggucccucug

SEQ ID NO: 39788 - RNA, 19 nt, Homo sapiens
ucuucacucggauaccucu

SEQ ID NO: 39789 - RNA, 20 nt, Homo sapiens
ugugcaacaaccacaugcca

SEQ ID NO: 39790 - RNA, 18 nt, Homo sapiens
aauaucacaccuccacuc

SEQ ID NO: 39791 - RNA, 17 nt, Homo sapiens
agcuccugaauuccuca

SEQ ID NO: 39792 - RNA, 24 nt, Homo sapiens
caucccugguggucaucucaggug

SEQ ID NO: 39793 - RNA, 19 nt, Homo sapiens
cuaucacccuggaugguau

SEQ ID NO: 39794 - RNA, 22 nt, Homo sapiens
gguccuugugauaggcaccaca

SEQ ID NO: 39795 - RNA, 24 nt, Homo sapiens
ucccacagcacucggugccuguca

SEQ ID NO: 39796 - RNA, 18 nt, Homo sapiens
acagcugguuucuauugc

SEQ ID NO: 39797 - RNA, 25 nt, Homo sapiens
aucuccugacuccaaauccauagca

SEQ ID NO: 39798 - RNA, 18 nt, Homo sapiens
ccacuggggugccuggau

SEQ ID NO: 39799 - RNA, 25 nt, Homo sapiens
gguuggagggcagggggcgcuggcc

SEQ ID NO: 39800 - RNA, 19 nt, Homo sapiens
uguuugaugcaucuuugaa

SEQ ID NO: 39801 - RNA, 16 nt, Homo sapiens
uucuggucccccaucc

SEQ ID NO: 39802 - RNA, 20 nt, Homo sapiens
cuuuacagaagcaaauagua

SEQ ID NO: 39803 - RNA, 18 nt, Homo sapiens
gccacaggcuggcagccu

SEQ ID NO: 39804 - RNA, 18 nt, Homo sapiens
uggacaguuggguucuga

SEQ ID NO: 39805 - RNA, 15 nt, Homo sapiens
accacacccaugugu

SEQ ID NO: 39806 - RNA, 19 nt, Homo sapiens
gcaaccagcacugcccugg

SEQ ID NO: 39807 - RNA, 16 nt, Homo sapiens
uucacuuucagcaguu

SEQ ID NO: 39808 - RNA, 21 nt, Homo sapiens
aaggccuguaguugaacauaa

SEQ ID NO: 39809 - RNA, 23 nt, Homo sapiens
accauugagaagacauuccgcuu

SEQ ID NO: 39810 - RNA, 22 nt, Homo sapiens
ggaccguguaagaggacaccac

SEQ ID NO: 39811 - RNA, 20 nt, Homo sapiens
ggcgucggcggcggcggcga

SEQ ID NO: 39812 - RNA, 21 nt, Homo sapiens
uaaaugcugaccuaaugugga

SEQ ID NO: 39813 - RNA, 25 nt, Homo sapiens
acuucucuccacccucuuuuugcau

SEQ ID NO: 39814 - RNA, 18 nt, Homo sapiens
auuccagaguucauucca

SEQ ID NO: 39815 - RNA, 24 nt, Homo sapiens
cgagaggcauagugaccugccuca

SEQ ID NO: 39816 - RNA, 17 nt, Homo sapiens
cugccuggccccaccuc

SEQ ID NO: 39817 - RNA, 20 nt, Homo sapiens
cuguuuaguaacuccaccuc

SEQ ID NO: 39818 - RNA, 17 nt, Homo sapiens
gacugagucaugugcca

SEQ ID NO: 39819 - RNA, 18 nt, Homo sapiens
uccuauauucagaguacu

SEQ ID NO: 39820 - RNA, 18 nt, Homo sapiens
ugcaagauagcuuuuccg

SEQ ID NO: 39821 - RNA, 19 nt, Homo sapiens
uuauauaguuuacaaaaua

SEQ ID NO: 39822 - RNA, 19 nt, Homo sapiens
accugucaaaaaaaugaca

SEQ ID NO: 39823 - RNA, 24 nt, Homo sapiens
cuacuugugugagauacucuucca

SEQ ID NO: 39824 - RNA, 21 nt, Homo sapiens
uaaucaaggcauggguauugc

SEQ ID NO: 39825 - RNA, 18 nt, Homo sapiens
uccugguaauggaccugc

SEQ ID NO: 39826 - RNA, 23 nt, Homo sapiens
uggaccugccagcgugugaacug

SEQ ID NO: 39827 - RNA, 16 nt, Homo sapiens
aggccucaaagcauug

SEQ ID NO: 39828 - RNA, 20 nt, Homo sapiens
aucugugaucaaaaugugaa

SEQ ID NO: 39829 - RNA, 22 nt, Homo sapiens
ccuuuaguuugcuaaacaccca

SEQ ID NO: 39830 - RNA, 21 nt, Homo sapiens
gauauaagcaaaaacaaguga

SEQ ID NO: 39831 - RNA, 20 nt, Homo sapiens
gcaccuuucauaucugcugu

SEQ ID NO: 39832 - RNA, 21 nt, Homo sapiens
ucuuguaggcaguguuccuca

SEQ ID NO: 39833 - RNA, 22 nt, Homo sapiens
uuaagaguaacaauaauuucua

SEQ ID NO: 39834 - RNA, 17 nt, Homo sapiens
ucauuugaccuuucaga

SEQ ID NO: 39835 - RNA, 22 nt, Homo sapiens
ucccucaaaugcuguaacuagg

SEQ ID NO: 39836 - RNA, 18 nt, Homo sapiens
caccuaccaacuuugccu

SEQ ID NO: 39837 - RNA, 19 nt, Homo sapiens
guaugaauucuuaauaccu

SEQ ID NO: 39838 - RNA, 18 nt, Homo sapiens
augcaaagacuugccaaa

SEQ ID NO: 39839 - RNA, 19 nt, Homo sapiens
caauuuugucggugccaau

SEQ ID NO: 39840 - RNA, 19 nt, Homo sapiens
ggaaagacucaagauugua

SEQ ID NO: 39841 - RNA, 20 nt, Homo sapiens
caaggcagcauucacuaagc

SEQ ID NO: 39842 - RNA, 17 nt, Homo sapiens
gguuaucaaagcugaca

SEQ ID NO: 39843 - RNA, 24 nt, Homo sapiens
uauuauuggcacucucuaacugaa

SEQ ID NO: 39844 - RNA, 21 nt, Homo sapiens
ucuacugcuuuuucuacuccu

SEQ ID NO: 39845 - RNA, 22 nt, Homo sapiens
ugaauauaaaaaucagcucuug

SEQ ID NO: 39846 - RNA, 18 nt, Homo sapiens
uucuacauagauguggua

SEQ ID NO: 39847 - RNA, 16 nt, Homo sapiens
aguaccaugguucuga

SEQ ID NO: 39848 - RNA, 25 nt, Homo sapiens
ccaucccaugucaccaccuggcuga

SEQ ID NO: 39849 - RNA, 21 nt, Homo sapiens
ccaugguucugacagagacug

SEQ ID NO: 39850 - RNA, 17 nt, Homo sapiens
ccuccaacuugacauca

SEQ ID NO: 39851 - RNA, 19 nt, Homo sapiens
gccucuggcccaggaguua

SEQ ID NO: 39852 - RNA, 20 nt, Homo sapiens
caaggcagcauucacuaagc

SEQ ID NO: 39853 - RNA, 17 nt, Homo sapiens
gguuaucaaagcugaca

SEQ ID NO: 39854 - RNA, 24 nt, Homo sapiens
uauuauuggcacucucuaacugaa

SEQ ID NO: 39855 - RNA, 21 nt, Homo sapiens
ucuacugcuuuuucuacuccu

SEQ ID NO: 39856 - RNA, 22 nt, Homo sapiens
ugaauauaaaaaucagcucuug

SEQ ID NO: 39857 - RNA, 18 nt, Homo sapiens
uucuacauagauguggua

SEQ ID NO: 39858 - RNA, 23 nt, Homo sapiens
gcacugaaggagaagaucugcca

SEQ ID NO: 39859 - RNA, 18 nt, Homo sapiens
uucacccaaauggucuca

SEQ ID NO: 39860 - RNA, 18 nt, Homo sapiens
accucauccuggacuuca

SEQ ID NO: 39861 - RNA, 19 nt, Homo sapiens
gaucucacucacuaucaug

SEQ ID NO: 39862 - RNA, 22 nt, Homo sapiens
gcggaagcaggaaugccuuaca

SEQ ID NO: 39863 - RNA, 19 nt, Homo sapiens
guuuccacuucugcagcaa

SEQ ID NO: 39864 - RNA, 23 nt, Homo sapiens
ugaagaucucugacauggugcug

SEQ ID NO: 39865 - RNA, 18 nt, Homo sapiens
uuuaaaguuccacagauc

SEQ ID NO: 39866 - RNA, 21 nt, Homo sapiens
aaguagcuucaaccaaagcua

SEQ ID NO: 39867 - RNA, 22 nt, Homo sapiens
agccaugcuuucuuagcuuuau

SEQ ID NO: 39868 - RNA, 22 nt, Homo sapiens
cagaaaggagguggcccaguca

SEQ ID NO: 39869 - RNA, 21 nt, Homo sapiens
gcaauggaauggacauuggca

SEQ ID NO: 39870 - RNA, 22 nt, Homo sapiens
gccugaaccagagcuauggcuc

SEQ ID NO: 39871 - RNA, 19 nt, Homo sapiens
uuuauacauuuucacuuag

SEQ ID NO: 39872 - RNA, 19 nt, Homo sapiens
ucaccauucacucaacaaa

SEQ ID NO: 39873 - RNA, 19 nt, Homo sapiens
acucaagcuuccaugugac

SEQ ID NO: 39874 - RNA, 19 nt, Homo sapiens
agagaggcgacagcugugg

SEQ ID NO: 39875 - RNA, 19 nt, Homo sapiens
cacagccuucuggcugcaa

SEQ ID NO: 39876 - RNA, 18 nt, Homo sapiens
ccaagagaggcgacagcu

SEQ ID NO: 39877 - RNA, 18 nt, Homo sapiens
ccuagcccagggacugga

SEQ ID NO: 39878 - RNA, 17 nt, Homo sapiens
gaggcgacagcuguggc

SEQ ID NO: 39879 - RNA, 17 nt, Homo sapiens
aaacacugaaaaacauc

SEQ ID NO: 39880 - RNA, 18 nt, Homo sapiens
uaccagaaaauaauacau

SEQ ID NO: 39881 - RNA, 21 nt, Homo sapiens
uuguuauauaaaugucaucau

SEQ ID NO: 39882 - RNA, 24 nt, Homo sapiens
gguuggcuggugaugcucuuucaa

SEQ ID NO: 39883 - RNA, 21 nt, Homo sapiens
guguguguuucugguuggcug

SEQ ID NO: 39884 - RNA, 17 nt, Homo sapiens
cuacaugccagcaacca

SEQ ID NO: 39885 - RNA, 19 nt, Homo sapiens
gcccuucaugguggugaau

SEQ ID NO: 39886 - RNA, 22 nt, Homo sapiens
ugaaacugcugguagagucaua

SEQ ID NO: 39887 - RNA, 20 nt, Homo sapiens
uugaggauggaaucuuugag

SEQ ID NO: 39888 - RNA, 18 nt, Homo sapiens
agcuucugagcuaccuuu

SEQ ID NO: 39889 - RNA, 23 nt, Homo sapiens
cuacuccugaccacuguauuuaa

SEQ ID NO: 39890 - RNA, 22 nt, Homo sapiens
ucacuucccucuucuucccuca

SEQ ID NO: 39891 - RNA, 18 nt, Homo sapiens
aaugacuucagacacuga

SEQ ID NO: 39892 - RNA, 16 nt, Homo sapiens
caaacauuccaucugg

SEQ ID NO: 39893 - RNA, 17 nt, Homo sapiens
ucagacacugaaggcuu

SEQ ID NO: 39894 - RNA, 16 nt, Homo sapiens
cacuagcccucacuca

SEQ ID NO: 39895 - RNA, 22 nt, Homo sapiens
uauuuccuggcaucaccccuua

SEQ ID NO: 39896 - RNA, 18 nt, Homo sapiens
ugaguccugcuuccuaca

SEQ ID NO: 39897 - RNA, 19 nt, Homo sapiens
ugucucuccuucucuagcu

SEQ ID NO: 39898 - RNA, 22 nt, Homo sapiens
aucucggcucacugcaaucucu

SEQ ID NO: 39899 - RNA, 20 nt, Homo sapiens
ucucugccucccggguucaa

SEQ ID NO: 39900 - RNA, 17 nt, Homo sapiens
uugaauuuguugcacaa

SEQ ID NO: 39901 - RNA, 20 nt, Homo sapiens
uuugcuugccccgcccccga

SEQ ID NO: 39902 - RNA, 23 nt, Homo sapiens
agguacagcacauaggccaggag

SEQ ID NO: 39903 - RNA, 21 nt, Homo sapiens
aucucccagcagguagagcag

SEQ ID NO: 39904 - RNA, 19 nt, Homo sapiens
cauuuccccaugccucuga

SEQ ID NO: 39905 - RNA, 20 nt, Homo sapiens
ccccaccaccacccccagcu

SEQ ID NO: 39906 - RNA, 21 nt, Homo sapiens
cucggcucgggaggccuggga

SEQ ID NO: 39907 - RNA, 18 nt, Homo sapiens
cugcagcccccugagaua

SEQ ID NO: 39908 - RNA, 21 nt, Homo sapiens
gcaucagacacagguacagca

SEQ ID NO: 39909 - RNA, 20 nt, Homo sapiens
gccucugugaucuucuccau

SEQ ID NO: 39910 - RNA, 19 nt, Homo sapiens
ggggucuaauaacaaacua

SEQ ID NO: 39911 - RNA, 21 nt, Homo sapiens
gguagagcagagccggagcca

SEQ ID NO: 39912 - RNA, 21 nt, Homo sapiens
uaaaccaauggaaagaagggg

SEQ ID NO: 39913 - RNA, 19 nt, Homo sapiens
ucugggaaaggaccugggg

SEQ ID NO: 39914 - RNA, 20 nt, Homo sapiens
ugccaaguacccugcuccag

SEQ ID NO: 39915 - RNA, 27 nt, Homo sapiens
ugggguggcagcugauuaggcccagca

SEQ ID NO: 39916 - RNA, 20 nt, Homo sapiens
uuggagagaaggucuccuug

SEQ ID NO: 39917 - RNA, 21 nt, Homo sapiens
agcuccuuuuuuuucaccuca

SEQ ID NO: 39918 - RNA, 21 nt, Homo sapiens
auuuggguuguuaccagguuu

SEQ ID NO: 39919 - RNA, 21 nt, Homo sapiens
caaccccucuuuccugcuccu

SEQ ID NO: 39920 - RNA, 22 nt, Homo sapiens
ccccaccgccacugcuuggcuu

SEQ ID NO: 39921 - RNA, 18 nt, Homo sapiens
ccucccccauaaucaaga

SEQ ID NO: 39922 - RNA, 18 nt, Homo sapiens
gccaugacaaauaaagcu

SEQ ID NO: 39923 - RNA, 21 nt, Homo sapiens
guugcaaauaaggaagaugua

SEQ ID NO: 39924 - RNA, 20 nt, Homo sapiens
ugggaagugcuuggguucgg

SEQ ID NO: 39925 - RNA, 24 nt, Homo sapiens
acguuuguucuguauugaugagua

SEQ ID NO: 39926 - RNA, 22 nt, Homo sapiens
agauuucagcaaugcuauuuca

SEQ ID NO: 39927 - RNA, 22 nt, Homo sapiens
agguuucaucccucacccuccc

SEQ ID NO: 39928 - RNA, 20 nt, Homo sapiens
auacacagcauaggguacgu

SEQ ID NO: 39929 - RNA, 24 nt, Homo sapiens
ccuaggguuuguaaaagaaaucca

SEQ ID NO: 39930 - RNA, 22 nt, Homo sapiens
ccuuuauccuaacggcuguuca

SEQ ID NO: 39931 - RNA, 21 nt, Homo sapiens
uccaucaaagccaccaccuca

SEQ ID NO: 39932 - RNA, 19 nt, Homo sapiens
ucuagcaaaauccaugucc

SEQ ID NO: 39933 - RNA, 18 nt, Homo sapiens
agggcaaucugucuuuaa

SEQ ID NO: 39934 - RNA, 18 nt, Homo sapiens
caucacccgccucacggg

SEQ ID NO: 39935 - RNA, 18 nt, Homo sapiens
ggggccagcccugcagug

SEQ ID NO: 39936 - RNA, 22 nt, Homo sapiens
guggacgagaacacguucucca

SEQ ID NO: 39937 - RNA, 20 nt, Homo sapiens
uuccaggaauagcgcuccag

SEQ ID NO: 39938 - RNA, 20 nt, Homo sapiens
acccucuguccuccucccuc

SEQ ID NO: 39939 - RNA, 20 nt, Homo sapiens
ccccgcccccguccccaagc

SEQ ID NO: 39940 - RNA, 17 nt, Homo sapiens
aaccaggaaggacguag

SEQ ID NO: 39941 - RNA, 21 nt, Homo sapiens
cuuguguuaccuuugcagcca

SEQ ID NO: 39942 - RNA, 17 nt, Homo sapiens
aaccaggaaggacguag

SEQ ID NO: 39943 - RNA, 21 nt, Homo sapiens
cuuguguuaccuuugcagcca

SEQ ID NO: 39944 - RNA, 20 nt, Homo sapiens
acuccugucucuguagaaua

SEQ ID NO: 39945 - RNA, 18 nt, Homo sapiens
uggaugaaacugagauug

SEQ ID NO: 39946 - RNA, 18 nt, Homo sapiens
uggaugaaacugagauug

SEQ ID NO: 39947 - RNA, 20 nt, Homo sapiens
uggcauuccagcaggagcua

SEQ ID NO: 39948 - RNA, 24 nt, Homo sapiens
gaucaguaauaucaaagagcaccu

SEQ ID NO: 39949 - RNA, 22 nt, Homo sapiens
acccagagcaucucccacuucc

SEQ ID NO: 39950 - RNA, 20 nt, Homo sapiens
accuggacuguggugggcuc

SEQ ID NO: 39951 - RNA, 18 nt, Homo sapiens
caccaccaccgccuccuc

SEQ ID NO: 39952 - RNA, 22 nt, Homo sapiens
cuccaggcccuggacacccugc

SEQ ID NO: 39953 - RNA, 21 nt, Homo sapiens
gaggcccaggcccucgagcca

SEQ ID NO: 39954 - RNA, 23 nt, Homo sapiens
gaugcccauuauucucaaacgua

SEQ ID NO: 39955 - RNA, 19 nt, Homo sapiens
ggaaucuucccagacccca

SEQ ID NO: 39956 - RNA, 23 nt, Homo sapiens
caccaucagauccaucagcgcug

SEQ ID NO: 39957 - RNA, 22 nt, Homo sapiens
aaaacaaauuguuuuaaauguu

SEQ ID NO: 39958 - RNA, 20 nt, Homo sapiens
aggacccugaaaauaagcac

SEQ ID NO: 39959 - RNA, 17 nt, Homo sapiens
aguaaagcaucauccuc

SEQ ID NO: 39960 - RNA, 21 nt, Homo sapiens
ccugaggaguuauuggcaaga

SEQ ID NO: 39961 - RNA, 19 nt, Homo sapiens
gauuucauacaacugaguu

SEQ ID NO: 39962 - RNA, 18 nt, Homo sapiens
ucugagaaugccugcgga

SEQ ID NO: 39963 - RNA, 19 nt, Homo sapiens
agcgugucccacuccaacu

SEQ ID NO: 39964 - RNA, 19 nt, Homo sapiens
caacggaugccacuauugg

SEQ ID NO: 39965 - RNA, 17 nt, Homo sapiens
gaucacucccuuggcuu

SEQ ID NO: 39966 - RNA, 16 nt, Homo sapiens
gccugucaccauggca

SEQ ID NO: 39967 - RNA, 22 nt, Homo sapiens
ccacugugguuugccacacuga

SEQ ID NO: 39968 - RNA, 20 nt, Homo sapiens
cccugggcagcagcacuuca

SEQ ID NO: 39969 - RNA, 19 nt, Homo sapiens
aaggacaucagaaauagca

SEQ ID NO: 39970 - RNA, 17 nt, Homo sapiens
agcuccccugagucuca

SEQ ID NO: 39971 - RNA, 20 nt, Homo sapiens
ccagagccacuuccucugaa

SEQ ID NO: 39972 - RNA, 21 nt, Homo sapiens
ccuguucaccucuugggucuc

SEQ ID NO: 39973 - RNA, 23 nt, Homo sapiens
ucaccucuugggucucuauccug

SEQ ID NO: 39974 - RNA, 20 nt, Homo sapiens
uccuguguaaccucuggugu

SEQ ID NO: 39975 - RNA, 19 nt, Homo sapiens
uaguuauggaguuuuugca

SEQ ID NO: 39976 - RNA, 19 nt, Homo sapiens
acuugcucacaacugugac

SEQ ID NO: 39977 - RNA, 18 nt, Homo sapiens
aauaaggagccuuuauua

SEQ ID NO: 39978 - RNA, 24 nt, Homo sapiens
acuuggaagcguauggccuggccc

SEQ ID NO: 39979 - RNA, 22 nt, Homo sapiens
ccagacacugaggguuccaucc

SEQ ID NO: 39980 - RNA, 26 nt, Homo sapiens
ccaggacgacugggagggcggccuca

SEQ ID NO: 39981 - RNA, 21 nt, Homo sapiens
ccugcuccccgaggccggcga

SEQ ID NO: 39982 - RNA, 20 nt, Homo sapiens
gcggaagugaggaguucugg

SEQ ID NO: 39983 - RNA, 18 nt, Homo sapiens
ggacggcccaccgccucu

SEQ ID NO: 39984 - RNA, 15 nt, Homo sapiens
gaacccccuuggcuu

SEQ ID NO: 39985 - RNA, 23 nt, Homo sapiens
auuaauaccugguuuagcggcaa

SEQ ID NO: 39986 - RNA, 22 nt, Homo sapiens
cuuaaacacccagaagcaguaa

SEQ ID NO: 39987 - RNA, 24 nt, Homo sapiens
gcccaugaacaaguuaguuucuca

SEQ ID NO: 39988 - RNA, 22 nt, Homo sapiens
ugguaaucauuuucuucaggga

SEQ ID NO: 39989 - RNA, 24 nt, Homo sapiens
accaauaucuuggcacauggcaga

SEQ ID NO: 39990 - RNA, 25 nt, Homo sapiens
agccuccucuccuaucggcacuguu

SEQ ID NO: 39991 - RNA, 21 nt, Homo sapiens
augccuccagccuuugcugcu

SEQ ID NO: 39992 - RNA, 21 nt, Homo sapiens
uuugagcucauuaaugcugcu

SEQ ID NO: 39993 - RNA, 23 nt, Homo sapiens
cccacagccuuggcccugcugcu

SEQ ID NO: 39994 - RNA, 20 nt, Homo sapiens
ccccgcacccuccccacagc

SEQ ID NO: 39995 - RNA, 18 nt, Homo sapiens
uuuccccucaaugccccg

SEQ ID NO: 39996 - RNA, 18 nt, Homo sapiens
cuuggagaagcuugugaa

SEQ ID NO: 39997 - RNA, 21 nt, Homo sapiens
guguguaugaaguguuuauug

SEQ ID NO: 39998 - RNA, 22 nt, Homo sapiens
uccugauggacaacuaugugag

SEQ ID NO: 39999 - RNA, 20 nt, Homo sapiens
acaggguaaaauccugcagc

SEQ ID NO: 40000 - RNA, 22 nt, Homo sapiens
acauuaauugggaaucauaugu

SEQ ID NO: 40001 - RNA, 18 nt, Homo sapiens
ccuggcaacauugugaga

SEQ ID NO: 40002 - RNA, 19 nt, Homo sapiens
gacggagucucggucuguc

SEQ ID NO: 40003 - RNA, 22 nt, Homo sapiens
gagguccucucccccaucccuc

SEQ ID NO: 40004 - RNA, 18 nt, Homo sapiens
gcacccaguccuguacgc

SEQ ID NO: 40005 - RNA, 18 nt, Homo sapiens
uccgccucccagguucaa

SEQ ID NO: 40006 - RNA, 19 nt, Homo sapiens
ccugaggagauucugugag

SEQ ID NO: 40007 - RNA, 20 nt, Homo sapiens
cgcagaaucaucuccguuga

SEQ ID NO: 40008 - RNA, 18 nt, Homo sapiens
gagguguuuggcauccca

SEQ ID NO: 40009 - RNA, 19 nt, Homo sapiens
ggaaaggaacaagcaccuu

SEQ ID NO: 40010 - RNA, 17 nt, Homo sapiens
gugaugcauuuuaccag

SEQ ID NO: 40011 - RNA, 17 nt, Homo sapiens
aaaaugucaaaaugaua

SEQ ID NO: 40012 - RNA, 16 nt, Homo sapiens
cgccauacacugcuuc

SEQ ID NO: 40013 - RNA, 18 nt, Homo sapiens
guugcaagaaaggaaaac

SEQ ID NO: 40014 - RNA, 23 nt, Homo sapiens
gcucugggagcaagagaagccga

SEQ ID NO: 40015 - RNA, 19 nt, Homo sapiens
ccugcucaccuuuugcugc

SEQ ID NO: 40016 - RNA, 18 nt, Homo sapiens
aaaaccucacuguaaaca

SEQ ID NO: 40017 - RNA, 20 nt, Homo sapiens
aaagauucaccaggcacugg

SEQ ID NO: 40018 - RNA, 18 nt, Homo sapiens
caucauggaaguauaacu

SEQ ID NO: 40019 - RNA, 19 nt, Homo sapiens
cuuccacacacagauuuaa

SEQ ID NO: 40020 - RNA, 20 nt, Homo sapiens
uggcauuccagcaggagcua

SEQ ID NO: 40021 - RNA, 22 nt, Homo sapiens
acgaaacaaggggaaguucuga

SEQ ID NO: 40022 - RNA, 24 nt, Homo sapiens
cauuugaugacaacuauaauacua

SEQ ID NO: 40023 - RNA, 20 nt, Homo sapiens
auugacaaaagaaccauuga

SEQ ID NO: 40024 - RNA, 19 nt, Homo sapiens
uuauaucaacauugucauc

SEQ ID NO: 40025 - RNA, 20 nt, Homo sapiens
aacugacaacauuguguaua

SEQ ID NO: 40026 - RNA, 24 nt, Homo sapiens
agggauaaaguugagaagugugcc

SEQ ID NO: 40027 - RNA, 19 nt, Homo sapiens
guaaaagcuucauguugag

SEQ ID NO: 40028 - RNA, 17 nt, Homo sapiens
ugguauucaaccagcaa

SEQ ID NO: 40029 - RNA, 21 nt, Homo sapiens
acgugucuucaacugacucac

SEQ ID NO: 40030 - RNA, 17 nt, Homo sapiens
aucaaguuccugccaua

SEQ ID NO: 40031 - RNA, 21 nt, Homo sapiens
auuagugaucauaaaauuuca

SEQ ID NO: 40032 - RNA, 19 nt, Homo sapiens
cagcacuccagccugggca

SEQ ID NO: 40033 - RNA, 18 nt, Homo sapiens
cagcacuuugggaagcca

SEQ ID NO: 40034 - RNA, 18 nt, Homo sapiens
cuuuaaucagacucccuu

SEQ ID NO: 40035 - RNA, 19 nt, Homo sapiens
aagcaauucuccugccuca

SEQ ID NO: 40036 - RNA, 26 nt, Homo sapiens
gaaguuguuuuuugggcaugagauug

SEQ ID NO: 40037 - RNA, 19 nt, Homo sapiens
gcauggaccccagcaguga

SEQ ID NO: 40038 - RNA, 18 nt, Homo sapiens
gcguggagcgucccgaga

SEQ ID NO: 40039 - RNA, 18 nt, Homo sapiens
gugacuaccauuuccuca

SEQ ID NO: 40040 - RNA, 18 nt, Homo sapiens
uccgccucccggguucaa

SEQ ID NO: 40041 - RNA, 22 nt, Homo sapiens
ugagauugugaauguggaacua

SEQ ID NO: 40042 - RNA, 19 nt, Homo sapiens
ucuggggguugcuuugcuu

SEQ ID NO: 40043 - RNA, 19 nt, Homo sapiens
cgcggugguggugggcuuu

SEQ ID NO: 40044 - RNA, 22 nt, Homo sapiens
gacugcgacggcgugcuguggc

SEQ ID NO: 40045 - RNA, 18 nt, Homo sapiens
ucuucguagagcccaagu

SEQ ID NO: 40046 - RNA, 18 nt, Homo sapiens
cagcaaacacaggcugca

SEQ ID NO: 40047 - RNA, 19 nt, Homo sapiens
ggacaaggagggcagcgac

SEQ ID NO: 40048 - RNA, 20 nt, Homo sapiens
uccacagccagccuucccuc

SEQ ID NO: 40049 - RNA, 16 nt, Homo sapiens
auaacugucaacuguu

SEQ ID NO: 40050 - RNA, 25 nt, Homo sapiens
gaaucuccugggaaucuaucccuaa

SEQ ID NO: 40051 - RNA, 19 nt, Homo sapiens
gcaaccaaaaacuggcuuu

SEQ ID NO: 40052 - RNA, 20 nt, Homo sapiens
ggaucccaugagaacauuau

SEQ ID NO: 40053 - RNA, 25 nt, Homo sapiens
ggguaccacaugaauugucuagcaa

SEQ ID NO: 40054 - RNA, 23 nt, Homo sapiens
ucuguuaccaaaauauuguguaa

SEQ ID NO: 40055 - RNA, 20 nt, Homo sapiens
uuuccauacuaaacaucaca

SEQ ID NO: 40056 - RNA, 20 nt, Homo sapiens
aaacacauguccucacugaa

SEQ ID NO: 40057 - RNA, 22 nt, Homo sapiens
cccacaacacaugauaaacaca

SEQ ID NO: 40058 - RNA, 25 nt, Homo sapiens
accgcgaccccacacuauuucugug

SEQ ID NO: 40059 - RNA, 22 nt, Homo sapiens
cauccugcgccccaauaccuca

SEQ ID NO: 40060 - RNA, 22 nt, Homo sapiens
ccauccugcgccccaauaccuc

SEQ ID NO: 40061 - RNA, 23 nt, Homo sapiens
cccuuccccacuucuuacacucc

SEQ ID NO: 40062 - RNA, 18 nt, Homo sapiens
ccugcgccccaauaccuc

SEQ ID NO: 40063 - RNA, 18 nt, Homo sapiens
cggcucagacgcacauca

SEQ ID NO: 40064 - RNA, 21 nt, Homo sapiens
gugcuguccacacucucuugc

SEQ ID NO: 40065 - RNA, 21 nt, Homo sapiens
uuacaacuauaaaggagguga

SEQ ID NO: 40066 - RNA, 18 nt, Homo sapiens
cauccagccucuugacaa

SEQ ID NO: 40067 - RNA, 21 nt, Homo sapiens
ccuuauuccucacuccaucca

SEQ ID NO: 40068 - RNA, 19 nt, Homo sapiens
ugaagcuuacaguacugca

SEQ ID NO: 40069 - RNA, 19 nt, Homo sapiens
ugaauaaaauucuguuagu

SEQ ID NO: 40070 - RNA, 22 nt, Homo sapiens
uuuuggugguggggggguugcg

SEQ ID NO: 40071 - RNA, 19 nt, Homo sapiens
accuguaacaaaaaucuca

SEQ ID NO: 40072 - RNA, 21 nt, Homo sapiens
aacccagccccagcgaccagg

SEQ ID NO: 40073 - RNA, 22 nt, Homo sapiens
uccccgccaccaccguccgcgu

SEQ ID NO: 40074 - RNA, 22 nt, Homo sapiens
aaaaacuacaaucaguauucuc

SEQ ID NO: 40075 - RNA, 19 nt, Homo sapiens
aaugagaucagccagauga

SEQ ID NO: 40076 - RNA, 18 nt, Homo sapiens
aauuuaaguauagauucu

SEQ ID NO: 40077 - RNA, 18 nt, Homo sapiens
auccaccaagauaccaga

SEQ ID NO: 40078 - RNA, 21 nt, Homo sapiens
cacauuuccuaaaaaaacagg

SEQ ID NO: 40079 - RNA, 20 nt, Homo sapiens
cccaaucaggagauuugugg

SEQ ID NO: 40080 - RNA, 19 nt, Homo sapiens
cccacaaaaacaugagaua

SEQ ID NO: 40081 - RNA, 20 nt, Homo sapiens
ccucugugacugcuucgccc

SEQ ID NO: 40082 - RNA, 18 nt, Homo sapiens
ccugaaacuacguagaga

SEQ ID NO: 40083 - RNA, 21 nt, Homo sapiens
gcuaugguguagagacaaaga

SEQ ID NO: 40084 - RNA, 23 nt, Homo sapiens
ugcugaacccugucuucuugaca

SEQ ID NO: 40085 - RNA, 18 nt, Homo sapiens
agaagaaaaacccuauca

SEQ ID NO: 40086 - RNA, 18 nt, Homo sapiens
agagaacacacacagggg

SEQ ID NO: 40087 - RNA, 19 nt, Homo sapiens
ucaguauugauucugcauc

SEQ ID NO: 40088 - RNA, 19 nt, Homo sapiens
accagagaauucacacugg

SEQ ID NO: 40089 - RNA, 18 nt, Homo sapiens
uuauucaacauuuauuca

SEQ ID NO: 40090 - RNA, 21 nt, Homo sapiens
cacuuacagggugccuacccc

SEQ ID NO: 40091 - RNA, 21 nt, Homo sapiens
aaccucuucacucucucccac

SEQ ID NO: 40092 - RNA, 25 nt, Homo sapiens
accacagggacaacauguccacuuu

SEQ ID NO: 40093 - RNA, 21 nt, Homo sapiens
acccacacacucaguacaaug

SEQ ID NO: 40094 - RNA, 21 nt, Homo sapiens
acugucagccagucauucacc

SEQ ID NO: 40095 - RNA, 21 nt, Homo sapiens
agccacacauucaccacagug

SEQ ID NO: 40096 - RNA, 21 nt, Homo sapiens
agccacucauucaccacagug

SEQ ID NO: 40097 - RNA, 17 nt, Homo sapiens
augacucaguuucaguu

SEQ ID NO: 40098 - RNA, 18 nt, Homo sapiens
cauguaccaaaugcaggg

SEQ ID NO: 40099 - RNA, 18 nt, Homo sapiens
ccacaugagaaccaguuc

SEQ ID NO: 40100 - RNA, 20 nt, Homo sapiens
ucacucucacccacucauuc

SEQ ID NO: 40101 - RNA, 20 nt, Homo sapiens
ucacucucucccacucauuc

SEQ ID NO: 40102 - RNA, 17 nt, Homo sapiens
ucuccuucaucauauca

SEQ ID NO: 40103 - RNA, 20 nt, Homo sapiens
uguccuggacagauguguua

SEQ ID NO: 40104 - RNA, 19 nt, Homo sapiens
agaaaauucauacgggugu

SEQ ID NO: 40105 - RNA, 19 nt, Homo sapiens
agaaaauucauacugaugu

SEQ ID NO: 40106 - RNA, 20 nt, Homo sapiens
agaaaauucauacuggugua

SEQ ID NO: 40107 - RNA, 16 nt, Homo sapiens
caaagccagaugugau

SEQ ID NO: 40108 - RNA, 18 nt, Homo sapiens
ggccagcugguuuguuau

SEQ ID NO: 40109 - RNA, 22 nt, Homo sapiens
uggaagcccucauugccaguca

SEQ ID NO: 40110 - RNA, 21 nt, Homo sapiens
uccaaaaugggacgcuugcca

SEQ ID NO: 40111 - RNA, 25 nt, Homo sapiens
aaaucaccaucugaagcuuuugaaa

SEQ ID NO: 40112 - RNA, 19 nt, Homo sapiens
cuaaauccaaacugucaaa

SEQ ID NO: 40113 - RNA, 15 nt, Homo sapiens
gucugggcugugaac

SEQ ID NO: 40114 - RNA, 18 nt, Homo sapiens
uucuuacuaaaaaucacc

SEQ ID NO: 40115 - RNA, 18 nt, Homo sapiens
ccucugauuuuagaucac

SEQ ID NO: 40116 - RNA, 21 nt, Homo sapiens
acacgguguuccuggucagcc

SEQ ID NO: 40117 - RNA, 18 nt, Homo sapiens
gcucacugccuuccuaca

SEQ ID NO: 40118 - RNA, 20 nt, Homo sapiens
gcauguguauuguaucaucc

SEQ ID NO: 40119 - RNA, 18 nt, Homo sapiens
ucaaaaauaccuucagga

SEQ ID NO: 40120 - RNA, 22 nt, Homo sapiens
uccaaaaauguugccucuacca

SEQ ID NO: 40121 - RNA, 21 nt, Homo sapiens
ugcccuuuuauaauacauaau

SEQ ID NO: 40122 - RNA, 20 nt, Homo sapiens
uguguuaacugaaagaacau

SEQ ID NO: 40123 - RNA, 21 nt, Homo sapiens
gccacagccacaagcaccuca

SEQ ID NO: 40124 - RNA, 17 nt, Homo sapiens
uccuggcccagguucuc

SEQ ID NO: 40125 - RNA, 17 nt, Homo sapiens
acuuggcuguauggcuu

SEQ ID NO: 40126 - RNA, 18 nt, Homo sapiens
agccuucccaguagcuca

SEQ ID NO: 40127 - RNA, 19 nt, Homo sapiens
uggggaaaaacucgugcca

SEQ ID NO: 40128 - RNA, 19 nt, Homo sapiens
ccagcggagcggagccugg

SEQ ID NO: 40129 - RNA, 19 nt, Homo sapiens
gcccuccggcggacccuca

SEQ ID NO: 40130 - RNA, 17 nt, Homo sapiens
gucuccggggcaagcca

SEQ ID NO: 40131 - RNA, 23 nt, Homo sapiens
acgaagcuccagaauccuggcca

SEQ ID NO: 40132 - RNA, 18 nt, Homo sapiens
auguuguccuucaucagc

SEQ ID NO: 40133 - RNA, 19 nt, Homo sapiens
uaggcucagaacuuuuaca

SEQ ID NO: 40134 - RNA, 18 nt, Homo sapiens
ccugucucccucucugaa

SEQ ID NO: 40135 - RNA, 23 nt, Homo sapiens
uaaaaaagcuggugggugaaaga

SEQ ID NO: 40136 - RNA, 21 nt, Homo sapiens
uuucaauaacgaaguugggca

SEQ ID NO: 40137 - RNA, 22 nt, Homo sapiens
uuuccaaaaaccaugucuccca

SEQ ID NO: 40138 - RNA, 20 nt, Homo sapiens
caugcuugggaagcaacuuu

SEQ ID NO: 40139 - RNA, 21 nt, Homo sapiens
uucugcuaaaacuacucuuuu

SEQ ID NO: 40140 - RNA, 19 nt, Homo sapiens
cagcacugggaacuuagca

SEQ ID NO: 40141 - RNA, 19 nt, Homo sapiens
ccaguacggcaagugccug

SEQ ID NO: 40142 - RNA, 18 nt, Homo sapiens
cggcuguuccaccugcca

SEQ ID NO: 40143 - RNA, 22 nt, Homo sapiens
ucagaggagaacggcuguucca

SEQ ID NO: 40144 - RNA, 19 nt, Homo sapiens
agaacuaaucauucagcaa

SEQ ID NO: 40145 - RNA, 20 nt, Homo sapiens
uaggugccccaagaaauuac

SEQ ID NO: 40146 - RNA, 22 nt, Homo sapiens
ucugcugggaccaggcacaacu

SEQ ID NO: 40147 - RNA, 19 nt, Homo sapiens
acagcauccucaucagugu

SEQ ID NO: 40148 - RNA, 19 nt, Homo sapiens
accaccaacuccucacuca

SEQ ID NO: 40149 - RNA, 20 nt, Homo sapiens
caagagggugcaagauguga

SEQ ID NO: 40150 - RNA, 18 nt, Homo sapiens
cauccaggcagucaagca

SEQ ID NO: 40151 - RNA, 20 nt, Homo sapiens
cgccuggucccuccaugaga

SEQ ID NO: 40152 - RNA, 21 nt, Homo sapiens
cuguggaccuagacaaugggg

SEQ ID NO: 40153 - RNA, 16 nt, Homo sapiens
gccaucuucaacuuca

SEQ ID NO: 40154 - RNA, 17 nt, Homo sapiens
gguggcucugcacuuga

SEQ ID NO: 40155 - RNA, 18 nt, Homo sapiens
ugggaccaacuucccaca

SEQ ID NO: 40156 - RNA, 22 nt, Homo sapiens
aggcaucgucaccagccacggc

SEQ ID NO: 40157 - RNA, 24 nt, Homo sapiens
acgcccuccacggcgucgucgcua

SEQ ID NO: 40158 - RNA, 21 nt, Homo sapiens
aacaaauaaaagcaugauaaa

SEQ ID NO: 40159 - RNA, 21 nt, Homo sapiens
aguaauuugguugacauuggg

SEQ ID NO: 40160 - RNA, 23 nt, Homo sapiens
ccugucuucccauccucauucaa

SEQ ID NO: 40161 - RNA, 20 nt, Homo sapiens
uauaugaauaggcuauggua

SEQ ID NO: 40162 - RNA, 18 nt, Homo sapiens
ugcccagagccuaugucc

SEQ ID NO: 40163 - RNA, 19 nt, Homo sapiens
aacagauucagaagacauu

SEQ ID NO: 40164 - RNA, 24 nt, Homo sapiens
accaauauuaccugaagugucaga

SEQ ID NO: 40165 - RNA, 18 nt, Homo sapiens
gauguacagugaaguauc

SEQ ID NO: 40166 - RNA, 21 nt, Homo sapiens
gugccucuucgugugaauuuu

SEQ ID NO: 40167 - RNA, 19 nt, Homo sapiens
ugugcuuaucuucacugua

SEQ ID NO: 40168 - RNA, 21 nt, Homo sapiens
aucuuggcucacugcaaacuc

SEQ ID NO: 40169 - RNA, 24 nt, Homo sapiens
cccacuggugcugagaccccaccc

SEQ ID NO: 40170 - RNA, 20 nt, Homo sapiens
gcuuaguugaaggaguuucg

SEQ ID NO: 40171 - RNA, 22 nt, Homo sapiens
uuccuuaaaaaacucauggaau

SEQ ID NO: 40172 - RNA, 17 nt, Homo sapiens
uucuccugcuucagccu

SEQ ID NO: 40173 - RNA, 20 nt, Homo sapiens
uuuugcuuuggggguuugug

SEQ ID NO: 40174 - RNA, 25 nt, Homo sapiens
cuuuuggcuggaauugaucaugaaa

SEQ ID NO: 40175 - RNA, 19 nt, Homo sapiens
gaccuuuuggcuggaauug

SEQ ID NO: 40176 - RNA, 18 nt, Homo sapiens
gggaucgcccgcuuccuu

SEQ ID NO: 40177 - RNA, 19 nt, Homo sapiens
ccuauggaaguauuuccga

SEQ ID NO: 40178 - RNA, 20 nt, Homo sapiens
caguauggggacauguucca

SEQ ID NO: 40179 - RNA, 19 nt, Homo sapiens
ggagguugagcuuccagaa

SEQ ID NO: 40180 - RNA, 20 nt, Homo sapiens
caguauggggacauguucca

SEQ ID NO: 40181 - RNA, 19 nt, Homo sapiens
ggagguugagcuuccagaa

SEQ ID NO: 40182 - RNA, 19 nt, Homo sapiens
ccuaagguggaccugugag

SEQ ID NO: 40183 - RNA, 18 nt, Homo sapiens
ccugguugggcggcccug

SEQ ID NO: 40184 - RNA, 19 nt, Homo sapiens
gccuaggcaucuucuuaua

SEQ ID NO: 40185 - RNA, 19 nt, Homo sapiens
guuguucaaauauaauaua

SEQ ID NO: 40186 - RNA, 20 nt, Homo sapiens
caggcaagagagaugccugc

SEQ ID NO: 40187 - RNA, 15 nt, Homo sapiens
gccacuuuuggcaga

SEQ ID NO: 40188 - RNA, 21 nt, Homo sapiens
ggcucccucguucugcagcaa

SEQ ID NO: 40189 - RNA, 17 nt, Homo sapiens
ugcaauaccagcuccuu

SEQ ID NO: 40190 - RNA, 19 nt, Homo sapiens
uuccagaacaaaaguguga

SEQ ID NO: 40191 - RNA, 20 nt, Homo sapiens
cuccacguucccucuccucu

SEQ ID NO: 40192 - RNA, 21 nt, Homo sapiens
ugcugugcccuugggcacccc

SEQ ID NO: 40193 - RNA, 20 nt, Homo sapiens
ccagagugucccucuaccca

SEQ ID NO: 40194 - RNA, 18 nt, Homo sapiens
gccaacuggacacagcgu

SEQ ID NO: 40195 - RNA, 17 nt, Homo sapiens
ucagcaaucagcauguc

SEQ ID NO: 40196 - RNA, 20 nt, Homo sapiens
ucuugguggcaagagcugug

SEQ ID NO: 40197 - RNA, 23 nt, Homo sapiens
aucuucaguuaggccugacacca

SEQ ID NO: 40198 - RNA, 23 nt, Homo sapiens
cgcuccaggagaaggcacccuua

SEQ ID NO: 40199 - RNA, 19 nt, Homo sapiens
cuuagaucuccaaaugcag

SEQ ID NO: 40200 - RNA, 18 nt, Homo sapiens
cuuuugggauuccgggga

SEQ ID NO: 40201 - RNA, 19 nt, Homo sapiens
gaaggaaaacauuccaaca

SEQ ID NO: 40202 - RNA, 22 nt, Homo sapiens
aaggauuuguuuuauauuauga

SEQ ID NO: 40203 - RNA, 24 nt, Homo sapiens
aguuggaggcuuuugcuguuuuua

SEQ ID NO: 40204 - RNA, 21 nt, Homo sapiens
cauuuguaaauuauauuuuca

SEQ ID NO: 40205 - RNA, 21 nt, Homo sapiens
gcuuuuuauuuuuuuacuuca

SEQ ID NO: 40206 - RNA, 23 nt, Homo sapiens
ugaaugggcuuucuaaauagcua

SEQ ID NO: 40207 - RNA, 19 nt, Homo sapiens
ugucugguaagucuuugaa

SEQ ID NO: 40208 - RNA, 19 nt, Homo sapiens
gccccggcccccauucccg

SEQ ID NO: 40209 - RNA, 16 nt, Homo sapiens
uugucucugcaguuca

SEQ ID NO: 40210 - RNA, 19 nt, Homo sapiens
caaggcacccuccagacug

SEQ ID NO: 40211 - RNA, 18 nt, Homo sapiens
cacacaggagcaccugga

SEQ ID NO: 40212 - RNA, 21 nt, Homo sapiens
cccucccccuauucacacccc

SEQ ID NO: 40213 - RNA, 16 nt, Homo sapiens
uguugagaacauggcc

SEQ ID NO: 40214 - RNA, 21 nt, Homo sapiens
auguuaccuucuugaauugcc

SEQ ID NO: 40215 - RNA, 18 nt, Homo sapiens
caguauuucaaaaagaaa

SEQ ID NO: 40216 - RNA, 19 nt, Homo sapiens
gaauauuaggaaacugcca

SEQ ID NO: 40217 - RNA, 24 nt, Homo sapiens
cuuuuuuauuacuguuaugauuuu

SEQ ID NO: 40218 - RNA, 19 nt, Homo sapiens
gaaaaauccccacucuucc

SEQ ID NO: 40219 - RNA, 17 nt, Homo sapiens
gaaaaugaagcucacuu

SEQ ID NO: 40220 - RNA, 22 nt, Homo sapiens
uccacuguagggucauccgcaa

SEQ ID NO: 40221 - RNA, 23 nt, Homo sapiens
ucugauggucugggcucauuuuu

SEQ ID NO: 40222 - RNA, 19 nt, Homo sapiens
cuguuuugcugaguuccca

SEQ ID NO: 40223 - RNA, 19 nt, Homo sapiens
gccgggugcgauggacucc

SEQ ID NO: 40224 - RNA, 15 nt, Homo sapiens
agcuucuuucccaca

SEQ ID NO: 40225 - RNA, 21 nt, Homo sapiens
agacugacuuagaccugggaa

SEQ ID NO: 40226 - RNA, 23 nt, Homo sapiens
ccccaagagccacuucccuucca

SEQ ID NO: 40227 - RNA, 19 nt, Homo sapiens
uugccccaagagccacuuc

SEQ ID NO: 40228 - RNA, 16 nt, Homo sapiens
uuuaaucuguccuuca

SEQ ID NO: 40229 - RNA, 20 nt, Homo sapiens
agaauacauguucacuucca

SEQ ID NO: 40230 - RNA, 21 nt, Homo sapiens
ucaaaggguggugaagaacua

SEQ ID NO: 40231 - RNA, 17 nt, Homo sapiens
aaguggauuuuauuugg

SEQ ID NO: 40232 - RNA, 18 nt, Homo sapiens
auuuuguuaacuauuaca

SEQ ID NO: 40233 - RNA, 18 nt, Homo sapiens
cauacuaauagucacuca

SEQ ID NO: 40234 - RNA, 22 nt, Homo sapiens
uaaugcgccccccccucuucuc

SEQ ID NO: 40235 - RNA, 19 nt, Homo sapiens
uucuuguucuuaaauucaa

SEQ ID NO: 40236 - RNA, 18 nt, Homo sapiens
uuuaugcuugaauaugaa

SEQ ID NO: 40237 - RNA, 21 nt, Homo sapiens
cgcgaaagccaacggacagga

SEQ ID NO: 40238 - RNA, 19 nt, Homo sapiens
gcacgcaugacauuucagu

SEQ ID NO: 40239 - RNA, 20 nt, Homo sapiens
cguuauaucaaugaaaaccu

SEQ ID NO: 40240 - RNA, 20 nt, Homo sapiens
uaacgguggugcaccauccu

SEQ ID NO: 40241 - RNA, 19 nt, Homo sapiens
aaagagugggaaucaguca

SEQ ID NO: 40242 - RNA, 18 nt, Homo sapiens
ccaaaaccucauguaaua

SEQ ID NO: 40243 - RNA, 23 nt, Homo sapiens
cccagcacaaccagguaucugcu

SEQ ID NO: 40244 - RNA, 18 nt, Homo sapiens
ggcacagaccccugccuc

SEQ ID NO: 40245 - RNA, 24 nt, Homo sapiens
cauagccacucuggaugcauauca

SEQ ID NO: 40246 - RNA, 21 nt, Homo sapiens
auuuuauuuauggccaguuuu

SEQ ID NO: 40247 - RNA, 24 nt, Homo sapiens
cagaagaauugaggaucugaugga

SEQ ID NO: 40248 - RNA, 21 nt, Homo sapiens
uggcaauggcagaagcccuga

SEQ ID NO: 40249 - RNA, 19 nt, Homo sapiens
aagagacuuucugcuuuca

SEQ ID NO: 40250 - RNA, 18 nt, Homo sapiens
ccucaucugcaggaguca

SEQ ID NO: 40251 - RNA, 20 nt, Homo sapiens
auauacgaggugaaacauua

SEQ ID NO: 40252 - RNA, 18 nt, Homo sapiens
uauacgaggugaaacauu

SEQ ID NO: 40253 - RNA, 20 nt, Homo sapiens
ggcaacgcuggcugguggcc

SEQ ID NO: 40254 - RNA, 19 nt, Homo sapiens
ggccaggcccaccuccauc

SEQ ID NO: 40255 - RNA, 22 nt, Homo sapiens
ggucuugggaggccugcagcag

SEQ ID NO: 40256 - RNA, 21 nt, Homo sapiens
agaagcccauucccgcccagu

SEQ ID NO: 40257 - RNA, 19 nt, Homo sapiens
agcuuccaggugugucuca

SEQ ID NO: 40258 - RNA, 21 nt, Homo sapiens
ccucacaguauagucuuucca

SEQ ID NO: 40259 - RNA, 21 nt, Homo sapiens
acaaaaacauucgaguugacc

SEQ ID NO: 40260 - RNA, 17 nt, Homo sapiens
accccauuccugugaaa

SEQ ID NO: 40261 - RNA, 18 nt, Homo sapiens
accuaccaacaacacuga

SEQ ID NO: 40262 - RNA, 16 nt, Homo sapiens
agccucauuuuccaca

SEQ ID NO: 40263 - RNA, 22 nt, Homo sapiens
agcuuccgcuuuuaucuuugaa

SEQ ID NO: 40264 - RNA, 24 nt, Homo sapiens
ccguggggauguaacuaucggcaa

SEQ ID NO: 40265 - RNA, 24 nt, Homo sapiens
cugcacucaucaaccugucaucua

SEQ ID NO: 40266 - RNA, 24 nt, Homo sapiens
ggcaaugacucugaggcuauaucu

SEQ ID NO: 40267 - RNA, 19 nt, Homo sapiens
ucauagaaaauaaggaacc

SEQ ID NO: 40268 - RNA, 19 nt, Homo sapiens
ucuguaugcuaacgccaca

SEQ ID NO: 40269 - RNA, 21 nt, Homo sapiens
ugcagcucacccacgugugcu

SEQ ID NO: 40270 - RNA, 19 nt, Homo sapiens
uugcaaagagacaagccuc

SEQ ID NO: 40271 - RNA, 20 nt, Homo sapiens
acauaaaugaaagucucaua

SEQ ID NO: 40272 - RNA, 24 nt, Homo sapiens
gucucauaaaauaucauaaagaua

SEQ ID NO: 40273 - RNA, 20 nt, Homo sapiens
aaaugggagaaaucacauca

SEQ ID NO: 40274 - RNA, 18 nt, Homo sapiens
cucuaaaaagccauugau

SEQ ID NO: 40275 - RNA, 22 nt, Homo sapiens
gaaaacucuaaaaagccauuga

SEQ ID NO: 40276 - RNA, 24 nt, Homo sapiens
caacaucauccucaucagcaguga

SEQ ID NO: 40277 - RNA, 20 nt, Homo sapiens
gacacccaacauuugagaga

SEQ ID NO: 40278 - RNA, 21 nt, Homo sapiens
gcaaacugcaggaccugaguu

SEQ ID NO: 40279 - RNA, 18 nt, Homo sapiens
uggaguucaaugagcuca

SEQ ID NO: 40280 - RNA, 21 nt, Homo sapiens
ccuccucguacaucgcgcuca

SEQ ID NO: 40281 - RNA, 18 nt, Homo sapiens
cgcgcucaucaccauggc

SEQ ID NO: 40282 - RNA, 18 nt, Homo sapiens
ggaggaggcggcgagcca

SEQ ID NO: 40283 - RNA, 18 nt, Homo sapiens
auccagaagagcaaaggc

SEQ ID NO: 40284 - RNA, 19 nt, Homo sapiens
aaacuccugaccucaggug

SEQ ID NO: 40285 - RNA, 22 nt, Homo sapiens
guagagacaggauuucaccaug

SEQ ID NO: 40286 - RNA, 17 nt, Homo sapiens
ucaagugauucuccugc

SEQ ID NO: 40287 - RNA, 18 nt, Homo sapiens
uccgccucccggguucaa

SEQ ID NO: 40288 - RNA, 17 nt, Homo sapiens
ucuagcuuucugcuuuu

SEQ ID NO: 40289 - RNA, 17 nt, Homo sapiens
uucuccugccuuagccu

SEQ ID NO: 40290 - RNA, 20 nt, Homo sapiens
agggaaaugcaaaucaaagc

SEQ ID NO: 40291 - RNA, 16 nt, Homo sapiens
gcauuacugcacucca

SEQ ID NO: 40292 - RNA, 22 nt, Homo sapiens
aaagagaggucccauuucauuu

SEQ ID NO: 40293 - RNA, 18 nt, Homo sapiens
ccuccagaguauuugaca

SEQ ID NO: 40294 - RNA, 16 nt, Homo sapiens
gaggacuaucuaacca

SEQ ID NO: 40295 - RNA, 21 nt, Homo sapiens
ggacaaccaccucguuccucu

SEQ ID NO: 40296 - RNA, 18 nt, Homo sapiens
uccucuugcaauuugugc

SEQ ID NO: 40297 - RNA, 18 nt, Homo sapiens
aaauccuaccaguuaugu

SEQ ID NO: 40298 - RNA, 20 nt, Homo sapiens
acuccagguagauuuccaca

SEQ ID NO: 40299 - RNA, 19 nt, Homo sapiens
gauuguuguguguuuuguu

SEQ ID NO: 40300 - RNA, 19 nt, Homo sapiens
ucugcugauauggaaugga

SEQ ID NO: 40301 - RNA, 21 nt, Homo sapiens
aacauguauuccaucgugcug

SEQ ID NO: 40302 - RNA, 18 nt, Homo sapiens
auguauuccaucgugcug

SEQ ID NO: 40303 - RNA, 22 nt, Homo sapiens
ccaauaaauugugccuuucuca

SEQ ID NO: 40304 - RNA, 18 nt, Homo sapiens
ccagcuuccuaugcaagg

SEQ ID NO: 40305 - RNA, 21 nt, Homo sapiens
ggaacggcgugaagccacugg

SEQ ID NO: 40306 - RNA, 21 nt, Homo sapiens
uccuggagugagacaagggcu

SEQ ID NO: 40307 - RNA, 21 nt, Homo sapiens
ugcugaggcuggaagaaaaac

SEQ ID NO: 40308 - RNA, 23 nt, Homo sapiens
ggacuuuccagugaugccacuga

SEQ ID NO: 40309 - RNA, 20 nt, Homo sapiens
aaggcgccaacagaguaguc

SEQ ID NO: 40310 - RNA, 25 nt, Homo sapiens
uuuugguuucuaggaaggucuuugg

SEQ ID NO: 40311 - RNA, 18 nt, Homo sapiens
acaaggaagaaaaaccug

SEQ ID NO: 40312 - RNA, 22 nt, Homo sapiens
cugccugguccugcccaccuca

SEQ ID NO: 40313 - RNA, 22 nt, Homo sapiens
cucuguucggggacccugugag

SEQ ID NO: 40314 - RNA, 18 nt, Homo sapiens
gcauaugaaauuuuugau

SEQ ID NO: 40315 - RNA, 23 nt, Homo sapiens
uacaauaaaucagggauuuuucc

SEQ ID NO: 40316 - RNA, 20 nt, Homo sapiens
uguccuucaaaaugaaacug

SEQ ID NO: 40317 - RNA, 22 nt, Homo sapiens
uucaacagcauaaaaucacgca

SEQ ID NO: 40318 - RNA, 23 nt, Homo sapiens
accuccacgugacuguuuggugc

SEQ ID NO: 40319 - RNA, 22 nt, Homo sapiens
ucuugcccuggggggcuuggaa

SEQ ID NO: 40320 - RNA, 24 nt, Homo sapiens
aaaaacacaguccuuuuauucuca

SEQ ID NO: 40321 - RNA, 21 nt, Homo sapiens
ugaaccacuaggguguugaaa

SEQ ID NO: 40322 - RNA, 17 nt, Homo sapiens
caugugguuugcagcaa

SEQ ID NO: 40323 - RNA, 17 nt, Homo sapiens
ucucaggucaguggcag

SEQ ID NO: 40324 - RNA, 20 nt, Homo sapiens
uuaaaauagaaauccugaca

SEQ ID NO: 40325 - RNA, 21 nt, Homo sapiens
cagugcucugugucuagcuua

SEQ ID NO: 40326 - RNA, 19 nt, Homo sapiens
guccuggggaaaacaugga

SEQ ID NO: 40327 - RNA, 19 nt, Homo sapiens
agcaacagauucuccagcu

SEQ ID NO: 40328 - RNA, 21 nt, Homo sapiens
ugaguggguuccacaggaaac

SEQ ID NO: 40329 - RNA, 18 nt, Homo sapiens
aacacuccuaaccucugu

SEQ ID NO: 40330 - RNA, 17 nt, Homo sapiens
ccaguugaccccaccuu

SEQ ID NO: 40331 - RNA, 20 nt, Homo sapiens
acaccccccaaaauagacua

SEQ ID NO: 40332 - RNA, 18 nt, Homo sapiens
agagcuuugacaaaccuc

SEQ ID NO: 40333 - RNA, 21 nt, Homo sapiens
cagaaggagcgacuccauuaa

SEQ ID NO: 40334 - RNA, 22 nt, Homo sapiens
ccaucuuugacccuaacacuuu

SEQ ID NO: 40335 - RNA, 23 nt, Homo sapiens
ccuugguggcaccucuccuggaa

SEQ ID NO: 40336 - RNA, 22 nt, Homo sapiens
gacugacuucuaccacacacuc

SEQ ID NO: 40337 - RNA, 21 nt, Homo sapiens
gcauaaugguuauugucacua

SEQ ID NO: 40338 - RNA, 19 nt, Homo sapiens
gccccuguccccucuguca

SEQ ID NO: 40339 - RNA, 24 nt, Homo sapiens
gcuuuaguacaacaaauaaagguc

SEQ ID NO: 40340 - RNA, 22 nt, Homo sapiens
ucaaggaacagauggaauccca

SEQ ID NO: 40341 - RNA, 20 nt, Homo sapiens
ucaugagugagcgugaccag

SEQ ID NO: 40342 - RNA, 20 nt, Homo sapiens
uggaaccucaaugggggcug

SEQ ID NO: 40343 - RNA, 20 nt, Homo sapiens
agauucaaucaccuuaccca

SEQ ID NO: 40344 - RNA, 22 nt, Homo sapiens
ccagauucaaucaccuuaccca

SEQ ID NO: 40345 - RNA, 21 nt, Homo sapiens
gaggaaggggccgcggcugga

SEQ ID NO: 40346 - RNA, 19 nt, Homo sapiens
acaaauuagaaccagaguu

SEQ ID NO: 40347 - RNA, 19 nt, Homo sapiens
caguuugcugagccugcca

SEQ ID NO: 40348 - RNA, 23 nt, Homo sapiens
ugccacucauugggccacacgcu

SEQ ID NO: 40349 - RNA, 18 nt, Homo sapiens
uggcuaggaaaaaacugc

SEQ ID NO: 40350 - RNA, 21 nt, Homo sapiens
uuccagaauauaugcauccag

SEQ ID NO: 40351 - RNA, 20 nt, Homo sapiens
aagaaauuaacccuaaccca

SEQ ID NO: 40352 - RNA, 18 nt, Homo sapiens
aagggaaagggaguguca

SEQ ID NO: 40353 - RNA, 19 nt, Homo sapiens
auccugaaagagaugaugg

SEQ ID NO: 40354 - RNA, 22 nt, Homo sapiens
caagagaacucuggccuaguca

SEQ ID NO: 40355 - RNA, 19 nt, Homo sapiens
uacuuuugauagcagacca

SEQ ID NO: 40356 - RNA, 21 nt, Homo sapiens
uccugaaagagaugauggacu

SEQ ID NO: 40357 - RNA, 23 nt, Homo sapiens
caaaaccguaggaauucugugaa

SEQ ID NO: 40358 - RNA, 23 nt, Homo sapiens
acggagucugcccaggccacacc

SEQ ID NO: 40359 - RNA, 19 nt, Homo sapiens
aaaggauagagugugugca

SEQ ID NO: 40360 - RNA, 20 nt, Homo sapiens
aggauagagugugugcauca

SEQ ID NO: 40361 - RNA, 19 nt, Homo sapiens
ccacugugauucucaacaa

SEQ ID NO: 40362 - RNA, 22 nt, Homo sapiens
cuauguauguauauacacacau

SEQ ID NO: 40363 - RNA, 20 nt, Homo sapiens
gcuucaugucaaacauguca

SEQ ID NO: 40364 - RNA, 21 nt, Homo sapiens
ucuaggugguuuuguuuacuu

SEQ ID NO: 40365 - RNA, 21 nt, Homo sapiens
ugaguggauccugguaaauac

SEQ ID NO: 40366 - RNA, 16 nt, Homo sapiens
uggccagguguagugg

SEQ ID NO: 40367 - RNA, 19 nt, Homo sapiens
uuugguggcauuuuguuca

SEQ ID NO: 40368 - RNA, 16 nt, Homo sapiens
accagagauuguaaua

SEQ ID NO: 40369 - RNA, 19 nt, Homo sapiens
cuugccuucuaggucacuu

SEQ ID NO: 40370 - RNA, 19 nt, Homo sapiens
gagauaaagagcagcuggg

SEQ ID NO: 40371 - RNA, 18 nt, Homo sapiens
uccugaggaugccgcgca

SEQ ID NO: 40372 - RNA, 19 nt, Homo sapiens
aaggugcugugucuaguca

SEQ ID NO: 40373 - RNA, 18 nt, Homo sapiens
ccucgccccugucccucu

SEQ ID NO: 40374 - RNA, 18 nt, Homo sapiens
uucugcacucaaauucca

SEQ ID NO: 40375 - RNA, 20 nt, Homo sapiens
ggcucagcaaagugacccua

SEQ ID NO: 40376 - RNA, 22 nt, Homo sapiens
aucuucagcagcucuggaugcu

SEQ ID NO: 40377 - RNA, 23 nt, Homo sapiens
cggaauucaucucgcugcugcug

SEQ ID NO: 40378 - RNA, 15 nt, Homo sapiens
gcaucauauuugcau

SEQ ID NO: 40379 - RNA, 23 nt, Homo sapiens
ggcaaaaugaugaaggaguucuc

SEQ ID NO: 40380 - RNA, 19 nt, Homo sapiens
uccaaucauauauucauca

SEQ ID NO: 40381 - RNA, 19 nt, Homo sapiens
agcacacccacaaaugcca

SEQ ID NO: 40382 - RNA, 21 nt, Homo sapiens
caguagggcauaauucagagc

SEQ ID NO: 40383 - RNA, 21 nt, Homo sapiens
guuguuuucauugccugcaga

SEQ ID NO: 40384 - RNA, 19 nt, Homo sapiens
ucugugguaacccugccca

SEQ ID NO: 40385 - RNA, 19 nt, Homo sapiens
uugugccagacccguugaa

SEQ ID NO: 40386 - RNA, 19 nt, Homo sapiens
agcccacgccucccaggga

SEQ ID NO: 40387 - RNA, 18 nt, Homo sapiens
cccaaacuuaaccuuuga

SEQ ID NO: 40388 - RNA, 20 nt, Homo sapiens
cgagaacucagcagcugcca

SEQ ID NO: 40389 - RNA, 24 nt, Homo sapiens
uucugaaagaaagaauuuugcccc

SEQ ID NO: 40390 - RNA, 24 nt, Homo sapiens
caucuccccaaaaacuaaauguga

SEQ ID NO: 40391 - RNA, 17 nt, Homo sapiens
ccccaacaaacuccucu

SEQ ID NO: 40392 - RNA, 19 nt, Homo sapiens
cucuuucucccuucugcuc

SEQ ID NO: 40393 - RNA, 17 nt, Homo sapiens
gccugcugcucucagga

SEQ ID NO: 40394 - RNA, 19 nt, Homo sapiens
gccugcuguauaaguaaca

SEQ ID NO: 40395 - RNA, 21 nt, Homo sapiens
uccugggagcccacaagaucc

SEQ ID NO: 40396 - RNA, 21 nt, Homo sapiens
ugcccugggccauaugugcua

SEQ ID NO: 40397 - RNA, 18 nt, Homo sapiens
ucccacccauccucuuuu

SEQ ID NO: 40398 - RNA, 21 nt, Homo sapiens
uuuaggggccaagaaauuuca

SEQ ID NO: 40399 - RNA, 19 nt, Homo sapiens
ccugagccgggaucugggg

SEQ ID NO: 40400 - RNA, 19 nt, Homo sapiens
cuugagcccaggcuggucu

SEQ ID NO: 40401 - RNA, 25 nt, Homo sapiens
ggcugacugccacccgccccauggg

SEQ ID NO: 40402 - RNA, 16 nt, Homo sapiens
uacaaaaauauguaga

SEQ ID NO: 40403 - RNA, 20 nt, Homo sapiens
aaccuggguguagcucauuu

SEQ ID NO: 40404 - RNA, 19 nt, Homo sapiens
acccugaguacaccccucu

SEQ ID NO: 40405 - RNA, 20 nt, Homo sapiens
aucacccccguucgcccuca

SEQ ID NO: 40406 - RNA, 19 nt, Homo sapiens
gacagcauugggucugguu

SEQ ID NO: 40407 - RNA, 24 nt, Homo sapiens
gcaccauguuccguuccuuuuuca

SEQ ID NO: 40408 - RNA, 18 nt, Homo sapiens
uugcaaaaaccaaccuuc

SEQ ID NO: 40409 - RNA, 19 nt, Homo sapiens
uuucccucaacaccugcuc

SEQ ID NO: 40410 - RNA, 22 nt, Homo sapiens
ugucuuugugguuuuuggaaua

SEQ ID NO: 40411 - RNA, 18 nt, Homo sapiens
agagccuuacucuuucca

SEQ ID NO: 40412 - RNA, 17 nt, Homo sapiens
cagcacuagcaguacca

SEQ ID NO: 40413 - RNA, 26 nt, Homo sapiens
gcgcuaccaagaaccaccacugggga

SEQ ID NO: 40414 - RNA, 19 nt, Homo sapiens
uaccaagaaccaccacugg

SEQ ID NO: 40415 - RNA, 19 nt, Homo sapiens
uccucuuuucccccuuuuc

SEQ ID NO: 40416 - RNA, 22 nt, Homo sapiens
aaaguaggcggucagccuuuca

SEQ ID NO: 40417 - RNA, 21 nt, Homo sapiens
caagauuaugauuuucaggcu

SEQ ID NO: 40418 - RNA, 24 nt, Homo sapiens
gugccuugguugggcuuugauucu

SEQ ID NO: 40419 - RNA, 22 nt, Homo sapiens
cacuguaccacagccugagcaa

SEQ ID NO: 40420 - RNA, 16 nt, Homo sapiens
ucccagcaggcugcaa

SEQ ID NO: 40421 - RNA, 16 nt, Homo sapiens
accagaagcugagcaa

SEQ ID NO: 40422 - RNA, 19 nt, Homo sapiens
accagccucccacugcaca

SEQ ID NO: 40423 - RNA, 16 nt, Homo sapiens
ccuccaggccuguggg

SEQ ID NO: 40424 - RNA, 20 nt, Homo sapiens
ccuuccccuuccucccucca

SEQ ID NO: 40425 - RNA, 21 nt, Homo sapiens
cugggcccaucccaggccuca

SEQ ID NO: 40426 - RNA, 20 nt, Homo sapiens
cuggucaaucaggcugauca

SEQ ID NO: 40427 - RNA, 22 nt, Homo sapiens
cuuuggugcaccaggccuugga

SEQ ID NO: 40428 - RNA, 22 nt, Homo sapiens
ucaacucccugggaguggaagc

SEQ ID NO: 40429 - RNA, 24 nt, Homo sapiens
ccccuuggucacaugaaccaggga

SEQ ID NO: 40430 - RNA, 19 nt, Homo sapiens
gacuucuaguguggaagug

SEQ ID NO: 40431 - RNA, 17 nt, Homo sapiens
gagugcaagcauggaac

SEQ ID NO: 40432 - RNA, 19 nt, Homo sapiens
aaacuccugaacucaggug

SEQ ID NO: 40433 - RNA, 18 nt, Homo sapiens
ccugcaaccuccaccucc

SEQ ID NO: 40434 - RNA, 18 nt, Homo sapiens
uaaguggaucaccugagg

SEQ ID NO: 40435 - RNA, 20 nt, Homo sapiens
uucaagugauucuccugcgc

SEQ ID NO: 40436 - RNA, 21 nt, Homo sapiens
agaaugaacccucacccuccc

SEQ ID NO: 40437 - RNA, 20 nt, Homo sapiens
auaaaguuccucccaguucc

SEQ ID NO: 40438 - RNA, 19 nt, Homo sapiens
cucuccuuuggcuaaucug

SEQ ID NO: 40439 - RNA, 20 nt, Homo sapiens
ucaaagacuacucauuucca

SEQ ID NO: 40440 - RNA, 18 nt, Homo sapiens
aucuauuccaaaucauua

SEQ ID NO: 40441 - RNA, 19 nt, Homo sapiens
cuccugcuuuaaccuuucc

SEQ ID NO: 40442 - RNA, 19 nt, Homo sapiens
ucauuuuugugccaaauga

SEQ ID NO: 40443 - RNA, 18 nt, Homo sapiens
uccuuuaauccuggcuca

SEQ ID NO: 40444 - RNA, 20 nt, Homo sapiens
ugcaacaugccccuugcucc

SEQ ID NO: 40445 - RNA, 18 nt, Homo sapiens
aucucucagaccagcuca

SEQ ID NO: 40446 - RNA, 23 nt, Homo sapiens
ccacgaacaccagcccaaacuga

SEQ ID NO: 40447 - RNA, 20 nt, Homo sapiens
cuccaaccugggacauccca

SEQ ID NO: 40448 - RNA, 19 nt, Homo sapiens
gccccggccgggcccagcc

SEQ ID NO: 40449 - RNA, 23 nt, Homo sapiens
aagcaccagacaccaugcagcug

SEQ ID NO: 40450 - RNA, 16 nt, Homo sapiens
acagagaggaaauccu

SEQ ID NO: 40451 - RNA, 20 nt, Homo sapiens
gcucccagccugcugagcac

SEQ ID NO: 40452 - RNA, 19 nt, Homo sapiens
ugcuuacucagggauccgg

SEQ ID NO: 40453 - RNA, 25 nt, Homo sapiens
aagugcggccccaucuccucuccgu

SEQ ID NO: 40454 - RNA, 18 nt, Homo sapiens
agugaaggagauaaacac

SEQ ID NO: 40455 - RNA, 19 nt, Homo sapiens
gguagagggaacaccauga

SEQ ID NO: 40456 - RNA, 18 nt, Homo sapiens
auuuaagguccuuugaua

SEQ ID NO: 40457 - RNA, 22 nt, Homo sapiens
auuugaguugugaaaaaggucu

SEQ ID NO: 40458 - RNA, 22 nt, Homo sapiens
cgccaggcugagaacuugcaaa

SEQ ID NO: 40459 - RNA, 19 nt, Homo sapiens
cucucccucagaaaccgcu

SEQ ID NO: 40460 - RNA, 19 nt, Homo sapiens
gagacuccaugaagccaca

SEQ ID NO: 40461 - RNA, 20 nt, Homo sapiens
gggcagggagacugccgcca

SEQ ID NO: 40462 - RNA, 18 nt, Homo sapiens
uaauuuccuucuguuccu

SEQ ID NO: 40463 - RNA, 18 nt, Homo sapiens
ucugaacaauauugucuu

SEQ ID NO: 40464 - RNA, 19 nt, Homo sapiens
acucucaaugugaugauua

SEQ ID NO: 40465 - RNA, 19 nt, Homo sapiens
auaacgaguaugcaauuug

SEQ ID NO: 40466 - RNA, 17 nt, Homo sapiens
gagguaacugggcuuag

SEQ ID NO: 40467 - RNA, 21 nt, Homo sapiens
gaaacacaaauuauagcauaa

SEQ ID NO: 40468 - RNA, 19 nt, Homo sapiens
cccuggugaugggcguugc

SEQ ID NO: 40469 - RNA, 19 nt, Homo sapiens
ccuagccacagcuguugua

SEQ ID NO: 40470 - RNA, 21 nt, Homo sapiens
gcguugcaaaguuuucacuga

SEQ ID NO: 40471 - RNA, 18 nt, Homo sapiens
guaaccgguuuuguugca

SEQ ID NO: 40472 - RNA, 20 nt, Homo sapiens
uaccaugaaaaaacuacaua

SEQ ID NO: 40473 - RNA, 22 nt, Homo sapiens
uuuaggagucuauuucuuacca

SEQ ID NO: 40474 - RNA, 19 nt, Homo sapiens
accaccugucuuuugcaua

SEQ ID NO: 40475 - RNA, 18 nt, Homo sapiens
ccaggauacugauacucc

SEQ ID NO: 40476 - RNA, 18 nt, Homo sapiens
ccaguuauccucuccucu

SEQ ID NO: 40477 - RNA, 19 nt, Homo sapiens
ccuucaaaccaucugccag

SEQ ID NO: 40478 - RNA, 18 nt, Homo sapiens
ccuuuuuuccuuuucacc

SEQ ID NO: 40479 - RNA, 15 nt, Homo sapiens
uauccucuccucuga

SEQ ID NO: 40480 - RNA, 18 nt, Homo sapiens
uuacuuggaaauccaugc

SEQ ID NO: 40481 - RNA, 21 nt, Homo sapiens
aaaacaaaagcaaaaacaaac

SEQ ID NO: 40482 - RNA, 20 nt, Homo sapiens
accuuguacaugugaaaccu

SEQ ID NO: 40483 - RNA, 21 nt, Homo sapiens
ugccaucaauauuuuagacug

SEQ ID NO: 40484 - RNA, 21 nt, Homo sapiens
auauccuuuucaagcauaaca

SEQ ID NO: 40485 - RNA, 21 nt, Homo sapiens
auuugaguagcacuguuuggu

SEQ ID NO: 40486 - RNA, 20 nt, Homo sapiens
ccaccuaacccuaccuacug

SEQ ID NO: 40487 - RNA, 23 nt, Homo sapiens
ccuuugguucuggcauggcauua

SEQ ID NO: 40488 - RNA, 22 nt, Homo sapiens
gagccaagaucacaccacugca

SEQ ID NO: 40489 - RNA, 19 nt, Homo sapiens
ugucuuuuagucauuucuu

SEQ ID NO: 40490 - RNA, 20 nt, Homo sapiens
uuauacauuaaaaauagugu

SEQ ID NO: 40491 - RNA, 18 nt, Homo sapiens
uugauaccaugcacuuuu

SEQ ID NO: 40492 - RNA, 24 nt, Homo sapiens
cccaccaaacuccgccucauccca

SEQ ID NO: 40493 - RNA, 23 nt, Homo sapiens
uccacggccagggcucuccuccc

SEQ ID NO: 40494 - RNA, 27 nt, Homo sapiens
ugacaucccccugccucuaucuucuuc

SEQ ID NO: 40495 - RNA, 19 nt, Homo sapiens
uggguggaucaccugagau

SEQ ID NO: 40496 - RNA, 19 nt, Homo sapiens
uguccugucggugugcucu

SEQ ID NO: 40497 - RNA, 19 nt, Homo sapiens
agauccuucagaaauguca

SEQ ID NO: 40498 - RNA, 21 nt, Homo sapiens
ucaccuucuuuuugcuuucua

SEQ ID NO: 40499 - RNA, 21 nt, Homo sapiens
aacucaggaccuuacugugaa

SEQ ID NO: 40500 - RNA, 18 nt, Homo sapiens
aaucauugagucauuuuu

SEQ ID NO: 40501 - RNA, 23 nt, Homo sapiens
cuucagcguuuuaaauuguuuuu

SEQ ID NO: 40502 - RNA, 24 nt, Homo sapiens
gcagaacuguacaccccugucaua

SEQ ID NO: 40503 - RNA, 21 nt, Homo sapiens
cacagccccucggcgaucuca

SEQ ID NO: 40504 - RNA, 17 nt, Homo sapiens
accuuucuucuuuguag

SEQ ID NO: 40505 - RNA, 20 nt, Homo sapiens
ccucuccugccuuugaccuc

SEQ ID NO: 40506 - RNA, 26 nt, Homo sapiens
gccccaacucugcucccagcaagcca

SEQ ID NO: 40507 - RNA, 21 nt, Homo sapiens
gggcaccuccacaucuggcug

SEQ ID NO: 40508 - RNA, 17 nt, Homo sapiens
ucuccugccuuugaccu

SEQ ID NO: 40509 - RNA, 19 nt, Homo sapiens
ugggaggacgagagccgga

SEQ ID NO: 40510 - RNA, 20 nt, Homo sapiens
uucaagaccagccugaccaa

SEQ ID NO: 40511 - RNA, 23 nt, Homo sapiens
aggaacacaucuccugcacuucu

SEQ ID NO: 40512 - RNA, 20 nt, Homo sapiens
cacagccuggccugcuccuc

SEQ ID NO: 40513 - RNA, 19 nt, Homo sapiens
ccaccugagcaccauccug

SEQ ID NO: 40514 - RNA, 24 nt, Homo sapiens
ccuucccaugcaggaugacugcuc

SEQ ID NO: 40515 - RNA, 26 nt, Homo sapiens
gccugaaccaugcucacuucuggucc

SEQ ID NO: 40516 - RNA, 19 nt, Homo sapiens
uacucuuacccucaacucu

SEQ ID NO: 40517 - RNA, 21 nt, Homo sapiens
ugaaggaggaaaacaaggcaa

SEQ ID NO: 40518 - RNA, 19 nt, Homo sapiens
aggcaggcgaauuacuuca

SEQ ID NO: 40519 - RNA, 20 nt, Homo sapiens
gccccaccuucauuuuucca

SEQ ID NO: 40520 - RNA, 24 nt, Homo sapiens
uacagcaaccauaggaagcuaaua

SEQ ID NO: 40521 - RNA, 22 nt, Homo sapiens
uauccauuuccgagucccugga

SEQ ID NO: 40522 - RNA, 19 nt, Homo sapiens
ugggugacagugugaaacu

SEQ ID NO: 40523 - RNA, 20 nt, Homo sapiens
uggguggguccuuagggagc

SEQ ID NO: 40524 - RNA, 20 nt, Homo sapiens
cccaaacuccucccagcaag

SEQ ID NO: 40525 - RNA, 19 nt, Homo sapiens
cccacuuuguccugugaca

SEQ ID NO: 40526 - RNA, 21 nt, Homo sapiens
cugcuccaucuagguguccca

SEQ ID NO: 40527 - RNA, 15 nt, Homo sapiens
agcagaaacauccuc

SEQ ID NO: 40528 - RNA, 20 nt, Homo sapiens
cucucccaaccccugcucca

SEQ ID NO: 40529 - RNA, 19 nt, Homo sapiens
agugcugaaggacuccuca

SEQ ID NO: 40530 - RNA, 24 nt, Homo sapiens
cucugugacugaagggccugcgga

SEQ ID NO: 40531 - RNA, 27 nt, Homo sapiens
gugguggggaccaggggaucuucguca

SEQ ID NO: 40532 - RNA, 18 nt, Homo sapiens
caggguugggaggccuag

SEQ ID NO: 40533 - RNA, 18 nt, Homo sapiens
gcccaccucauaaccaua

SEQ ID NO: 40534 - RNA, 18 nt, Homo sapiens
uuuuugucuccacuggcu

SEQ ID NO: 40535 - RNA, 23 nt, Homo sapiens
gccaccccucuagggacccagga

SEQ ID NO: 40536 - RNA, 22 nt, Homo sapiens
gccgggggcggcuguuuggccu

SEQ ID NO: 40537 - RNA, 20 nt, Homo sapiens
gcgcccgcccgccccgcccu

SEQ ID NO: 40538 - RNA, 24 nt, Homo sapiens
ggcgcggccuucagcguggggcug

SEQ ID NO: 40539 - RNA, 19 nt, Homo sapiens
uaugauugugccacugcac

SEQ ID NO: 40540 - RNA, 19 nt, Homo sapiens
cagacagcccccugugcaa

SEQ ID NO: 40541 - RNA, 21 nt, Homo sapiens
accuggaaaucagccuggcuu

SEQ ID NO: 40542 - RNA, 20 nt, Homo sapiens
ucacuuauuuugcuaaauaa

SEQ ID NO: 40543 - RNA, 22 nt, Homo sapiens
caacacugcugucuuuaagcuu

SEQ ID NO: 40544 - RNA, 21 nt, Homo sapiens
ccagcaucuucacuugucaua

SEQ ID NO: 40545 - RNA, 24 nt, Homo sapiens
gggaggagagguuggaagcugcca

SEQ ID NO: 40546 - RNA, 17 nt, Homo sapiens
uagauagauagauacau

SEQ ID NO: 40547 - RNA, 21 nt, Homo sapiens
ucauugugucaauuccugcaa

SEQ ID NO: 40548 - RNA, 17 nt, Homo sapiens
ucugcacugauccucua

SEQ ID NO: 40549 - RNA, 23 nt, Homo sapiens
uugacacaaccccuucccauuca

SEQ ID NO: 40550 - RNA, 21 nt, Homo sapiens
uuucugaucaugguaugugcu

SEQ ID NO: 40551 - RNA, 18 nt, Homo sapiens
guaugaggccgggugcag

SEQ ID NO: 40552 - RNA, 22 nt, Homo sapiens
acuugaaaggugugcuugguuu

SEQ ID NO: 40553 - RNA, 22 nt, Homo sapiens
agauucaacuuuaccauccaca

SEQ ID NO: 40554 - RNA, 20 nt, Homo sapiens
cagauggcugagaagccacu

SEQ ID NO: 40555 - RNA, 18 nt, Homo sapiens
ccagccaaugagauguaa

SEQ ID NO: 40556 - RNA, 20 nt, Homo sapiens
ugguccuaagagugaaggaa

SEQ ID NO: 40557 - RNA, 21 nt, Homo sapiens
gcugucccgggaccccgagga

SEQ ID NO: 40558 - RNA, 19 nt, Homo sapiens
ugcuguccgcgcugcccgc

SEQ ID NO: 40559 - RNA, 21 nt, Homo sapiens
acuuuuuuuccacaacuuuuu

SEQ ID NO: 40560 - RNA, 24 nt, Homo sapiens
agucccaucaccaggcagccauga

SEQ ID NO: 40561 - RNA, 20 nt, Homo sapiens
caucauccugggcacgccgu

SEQ ID NO: 40562 - RNA, 24 nt, Homo sapiens
ccagcugaucgggucaggcaaguc

SEQ ID NO: 40563 - RNA, 23 nt, Homo sapiens
cccuuccagccccucuuuuccag

SEQ ID NO: 40564 - RNA, 19 nt, Homo sapiens
ccucuaaacacaucccucc

SEQ ID NO: 40565 - RNA, 20 nt, Homo sapiens
cucuccaacugccagcugau

SEQ ID NO: 40566 - RNA, 17 nt, Homo sapiens
gcccccuucuucuguga

SEQ ID NO: 40567 - RNA, 20 nt, Homo sapiens
guuacacagcuacaguaugu

SEQ ID NO: 40568 - RNA, 18 nt, Homo sapiens
cccuggaggaucuggaga

SEQ ID NO: 40569 - RNA, 21 nt, Homo sapiens
acuuuuuuuccacaacuuuuu

SEQ ID NO: 40570 - RNA, 24 nt, Homo sapiens
agucccaucaccaggcagccauga

SEQ ID NO: 40571 - RNA, 20 nt, Homo sapiens
caucauccugggcacgccgu

SEQ ID NO: 40572 - RNA, 24 nt, Homo sapiens
ccagcugaucgggucaggcaaguc

SEQ ID NO: 40573 - RNA, 19 nt, Homo sapiens
ccucuaaacacaucccucc

SEQ ID NO: 40574 - RNA, 23 nt, Homo sapiens
ccuuuccagccccucuuuuccag

SEQ ID NO: 40575 - RNA, 17 nt, Homo sapiens
cuccccuuuccuuucca

SEQ ID NO: 40576 - RNA, 20 nt, Homo sapiens
cucuccaacugccagcugau

SEQ ID NO: 40577 - RNA, 17 nt, Homo sapiens
gcccccuucuucuguga

SEQ ID NO: 40578 - RNA, 20 nt, Homo sapiens
guuacacagcuacaguaugu

SEQ ID NO: 40579 - RNA, 20 nt, Homo sapiens
gcgggucgcgagucgccggu

SEQ ID NO: 40580 - RNA, 17 nt, Homo sapiens
uuggacuuagauaaggg

SEQ ID NO: 40581 - RNA, 20 nt, Homo sapiens
aucucguguguguuaagaug

SEQ ID NO: 40582 - RNA, 21 nt, Homo sapiens
caaccuucauucucugacucc

SEQ ID NO: 40583 - RNA, 22 nt, Homo sapiens
cccgaguugggggauuugagag

SEQ ID NO: 40584 - RNA, 20 nt, Homo sapiens
gagacacagugaaaaggggu

SEQ ID NO: 40585 - RNA, 18 nt, Homo sapiens
ggcccuggcaggagauua

SEQ ID NO: 40586 - RNA, 21 nt, Homo sapiens
uuucccucaccgcagcucuca

SEQ ID NO: 40587 - RNA, 18 nt, Homo sapiens
guucacacuagcacuguu

SEQ ID NO: 40588 - RNA, 21 nt, Homo sapiens
ucccaaucacauuucacaaua

SEQ ID NO: 40589 - RNA, 18 nt, Homo sapiens
acagucuguauacaaaua

SEQ ID NO: 40590 - RNA, 19 nt, Homo sapiens
caauucagaucgugucaca

SEQ ID NO: 40591 - RNA, 18 nt, Homo sapiens
cuuaaguucugcagauca

SEQ ID NO: 40592 - RNA, 22 nt, Homo sapiens
guagccuaccaaaauuauacac

SEQ ID NO: 40593 - RNA, 24 nt, Homo sapiens
uuugcaucaguuugucuuggcuuu

SEQ ID NO: 40594 - RNA, 19 nt, Homo sapiens
agacaugcaguuugcuugc

SEQ ID NO: 40595 - RNA, 23 nt, Homo sapiens
aucugggaccugcaguuuggcuu

SEQ ID NO: 40596 - RNA, 20 nt, Homo sapiens
aacuuguuuaccaggaucag

SEQ ID NO: 40597 - RNA, 19 nt, Homo sapiens
aaucccagauaaucauauc

SEQ ID NO: 40598 - RNA, 20 nt, Homo sapiens
ccacugcaccugguccccca

SEQ ID NO: 40599 - RNA, 21 nt, Homo sapiens
uggcccacgcuggucuugaac

SEQ ID NO: 40600 - RNA, 25 nt, Homo sapiens
accguguucguggccgaccuggccu

SEQ ID NO: 40601 - RNA, 26 nt, Homo sapiens
accucuggguaucccuuugucuggga

SEQ ID NO: 40602 - RNA, 19 nt, Homo sapiens
augcuucagaaacaccuca

SEQ ID NO: 40603 - RNA, 19 nt, Homo sapiens
ccucuuuuccccccaugcu

SEQ ID NO: 40604 - RNA, 23 nt, Homo sapiens
ccuugaugguggaaugaccgggu

SEQ ID NO: 40605 - RNA, 17 nt, Homo sapiens
gaauggcuugccagugg

SEQ ID NO: 40606 - RNA, 19 nt, Homo sapiens
gacgaagaucugguuuaca

SEQ ID NO: 40607 - RNA, 18 nt, Homo sapiens
uguuccucuguguuguca

SEQ ID NO: 40608 - RNA, 18 nt, Homo sapiens
uuucuggucaacauuguu

SEQ ID NO: 40609 - RNA, 19 nt, Homo sapiens
aucugaauucuugucuggu

SEQ ID NO: 40610 - RNA, 20 nt, Homo sapiens
ugugggggauuuuguuggug

SEQ ID NO: 40611 - RNA, 24 nt, Homo sapiens
caugaaccagagccucaucuuuca

SEQ ID NO: 40612 - RNA, 18 nt, Homo sapiens
cguuuuaaaauucccuaa

SEQ ID NO: 40613 - RNA, 21 nt, Homo sapiens
uuuuuuuguuggaacccugca

SEQ ID NO: 40614 - RNA, 19 nt, Homo sapiens
gggcaaacgcuccgaccaa

SEQ ID NO: 40615 - RNA, 20 nt, Homo sapiens
aacaugucgucaggaaacuu

SEQ ID NO: 40616 - RNA, 22 nt, Homo sapiens
ccuuuucauuuagguuuacuuu

SEQ ID NO: 40617 - RNA, 17 nt, Homo sapiens
ucuaauauugaaauaug

SEQ ID NO: 40618 - RNA, 15 nt, Homo sapiens
ucuaggcaugcugcc

SEQ ID NO: 40619 - RNA, 22 nt, Homo sapiens
ugucuccauuccugccaucucu

SEQ ID NO: 40620 - RNA, 23 nt, Homo sapiens
ugaaaucucacaugucuaguuca

SEQ ID NO: 40621 - RNA, 23 nt, Homo sapiens
cggcauuuucccaucugccuuuu

SEQ ID NO: 40622 - RNA, 22 nt, Homo sapiens
uaucuguguagaaauacaacuc

SEQ ID NO: 40623 - RNA, 20 nt, Homo sapiens
caugaaguuucagucacuca

SEQ ID NO: 40624 - RNA, 17 nt, Homo sapiens
ggguugacuggguccag

SEQ ID NO: 40625 - RNA, 17 nt, Homo sapiens
ugaacagcgaguuuuga

SEQ ID NO: 40626 - RNA, 18 nt, Homo sapiens
ggcuuggcacccgccaaa

SEQ ID NO: 40627 - RNA, 17 nt, Homo sapiens
aaaaacaaacaaacaaa

SEQ ID NO: 40628 - RNA, 20 nt, Homo sapiens
agaaaaucaucaucccaucu

SEQ ID NO: 40629 - RNA, 19 nt, Homo sapiens
auuuuucagaaaacuucca

SEQ ID NO: 40630 - RNA, 24 nt, Homo sapiens
cagggcacguguuuuugagccucu

SEQ ID NO: 40631 - RNA, 18 nt, Homo sapiens
cuugcugugagaccauuu

SEQ ID NO: 40632 - RNA, 20 nt, Homo sapiens
gccccuguccuuggccaguc

SEQ ID NO: 40633 - RNA, 23 nt, Homo sapiens
ggggaauaagaguaggcucaguu

SEQ ID NO: 40634 - RNA, 19 nt, Homo sapiens
ggucuuggcgcgcuggccg

SEQ ID NO: 40635 - RNA, 21 nt, Homo sapiens
guuucagaaccaauuuaaaau

SEQ ID NO: 40636 - RNA, 19 nt, Homo sapiens
ucauagauacaauacuuua

SEQ ID NO: 40637 - RNA, 21 nt, Homo sapiens
ucuaagacaaugaaucauuuu

SEQ ID NO: 40638 - RNA, 21 nt, Homo sapiens
ucugaugaguaucucucugca

SEQ ID NO: 40639 - RNA, 19 nt, Homo sapiens
ugggucaaacauuguugua

SEQ ID NO: 40640 - RNA, 16 nt, Homo sapiens
uuccagaagcuuguuc

SEQ ID NO: 40641 - RNA, 17 nt, Homo sapiens
agugcucucuuaccuca

SEQ ID NO: 40642 - RNA, 16 nt, Homo sapiens
aucauuagcuauccca

SEQ ID NO: 40643 - RNA, 19 nt, Homo sapiens
aucucuguccccagccucu

SEQ ID NO: 40644 - RNA, 19 nt, Homo sapiens
cagcucacuaguuagcugu

SEQ ID NO: 40645 - RNA, 18 nt, Homo sapiens
gugacuguuguggacucu

SEQ ID NO: 40646 - RNA, 24 nt, Homo sapiens
ugggugggcuucaggcuggggcug

SEQ ID NO: 40647 - RNA, 22 nt, Homo sapiens
uucccugcucacauucucugga

SEQ ID NO: 40648 - RNA, 19 nt, Homo sapiens
ccaaagcugugggaucaca

SEQ ID NO: 40649 - RNA, 17 nt, Homo sapiens
cuaggcugcugcucuuu

SEQ ID NO: 40650 - RNA, 20 nt, Homo sapiens
ggacgacccugccuccgucu

SEQ ID NO: 40651 - RNA, 19 nt, Homo sapiens
uccuuagcuacccuguuuu

SEQ ID NO: 40652 - RNA, 17 nt, Homo sapiens
gcugagggcauaucuca

SEQ ID NO: 40653 - RNA, 21 nt, Homo sapiens
cacguggccaaccugccgcaa

SEQ ID NO: 40654 - RNA, 23 nt, Homo sapiens
ccauagcuggaccaaucaugaca

SEQ ID NO: 40655 - RNA, 21 nt, Homo sapiens
ccucuuuguagcucugugcuu

SEQ ID NO: 40656 - RNA, 19 nt, Homo sapiens
gcacagagggcggagcugg

SEQ ID NO: 40657 - RNA, 21 nt, Homo sapiens
ucccaggucagagaggagagu

SEQ ID NO: 40658 - RNA, 21 nt, Homo sapiens
ugggacuugcccaacuuuaaa

SEQ ID NO: 40659 - RNA, 18 nt, Homo sapiens
uugaaauacugugccuca

SEQ ID NO: 40660 - RNA, 21 nt, Homo sapiens
cacuuagugggcugcacuuuu

SEQ ID NO: 40661 - RNA, 21 nt, Homo sapiens
ccucauuaggccuggccaccu

SEQ ID NO: 40662 - RNA, 21 nt, Homo sapiens
aucuucauguggacauugaga

SEQ ID NO: 40663 - RNA, 20 nt, Homo sapiens
cucucggcucauuuugcaca

SEQ ID NO: 40664 - RNA, 19 nt, Homo sapiens
acagauauuaaacugauca

SEQ ID NO: 40665 - RNA, 19 nt, Homo sapiens
caccaccaccaccaccuuc

SEQ ID NO: 40666 - RNA, 17 nt, Homo sapiens
cucucccugcugccucu

SEQ ID NO: 40667 - RNA, 22 nt, Homo sapiens
cuuggaaacagaaggccugugg

SEQ ID NO: 40668 - RNA, 19 nt, Homo sapiens
gcugagagaaguuccucau

SEQ ID NO: 40669 - RNA, 20 nt, Homo sapiens
ggacuuuuccccaccuccuc

SEQ ID NO: 40670 - RNA, 22 nt, Homo sapiens
ggcaagcccagggaccccugga

SEQ ID NO: 40671 - RNA, 17 nt, Homo sapiens
ggugaagcugugacauc

SEQ ID NO: 40672 - RNA, 19 nt, Homo sapiens
ugacaugugucgucuucuc

SEQ ID NO: 40673 - RNA, 22 nt, Homo sapiens
acacaggccccagauccaguca

SEQ ID NO: 40674 - RNA, 19 nt, Homo sapiens
acccccacuccuauccuga

SEQ ID NO: 40675 - RNA, 22 nt, Homo sapiens
ccaacugagaagacuuggccca

SEQ ID NO: 40676 - RNA, 19 nt, Homo sapiens
cccgccgccuggaaguucu

SEQ ID NO: 40677 - RNA, 18 nt, Homo sapiens
cuuuaguuugccuuuaaa

SEQ ID NO: 40678 - RNA, 18 nt, Homo sapiens
gccgccuggaaguucuga

SEQ ID NO: 40679 - RNA, 18 nt, Homo sapiens
uccuuuaaucuguacugu

SEQ ID NO: 40680 - RNA, 19 nt, Homo sapiens
ugcaaaaucacugcaccuu

SEQ ID NO: 40681 - RNA, 19 nt, Homo sapiens
ugcaggaccagagccccuu

SEQ ID NO: 40682 - RNA, 21 nt, Homo sapiens
aauuaucuccugugcacauga

SEQ ID NO: 40683 - RNA, 18 nt, Homo sapiens
cugaaaacuuuccuacug

SEQ ID NO: 40684 - RNA, 18 nt, Homo sapiens
gcaauucaaaauuaucuc

SEQ ID NO: 40685 - RNA, 20 nt, Homo sapiens
ggacaagauaauucaaguca

SEQ ID NO: 40686 - RNA, 22 nt, Homo sapiens
uaaucauacaaaucagacuuua

SEQ ID NO: 40687 - RNA, 19 nt, Homo sapiens
uucaagaugacagauccaa

SEQ ID NO: 40688 - RNA, 22 nt, Homo sapiens
agucuauacugccaggcacuau

SEQ ID NO: 40689 - RNA, 18 nt, Homo sapiens
cuccucgagcucuuugaa

SEQ ID NO: 40690 - RNA, 19 nt, Homo sapiens
gcacuuauccaagucgugc

SEQ ID NO: 40691 - RNA, 16 nt, Homo sapiens
ugucucucuccucuga

SEQ ID NO: 40692 - RNA, 21 nt, Homo sapiens
ucagcccuaaccccaguguga

SEQ ID NO: 40693 - RNA, 16 nt, Homo sapiens
uccaaaaccuaccacu

SEQ ID NO: 40694 - RNA, 17 nt, Homo sapiens
gucucagcaggaucucu

SEQ ID NO: 40695 - RNA, 19 nt, Homo sapiens
cccacccagguuccugccu

SEQ ID NO: 40696 - RNA, 20 nt, Homo sapiens
gacggcucaggaacugggaa

SEQ ID NO: 40697 - RNA, 22 nt, Homo sapiens
agagcaagcaaagcgacccuga

SEQ ID NO: 40698 - RNA, 15 nt, Homo sapiens
uggaucuggccuggc

SEQ ID NO: 40699 - RNA, 22 nt, Homo sapiens
uggguugacgugcauggagcug

SEQ ID NO: 40700 - RNA, 21 nt, Homo sapiens
uggugacaccaggucugucca

SEQ ID NO: 40701 - RNA, 17 nt, Homo sapiens
uugcagacuucuggccu

SEQ ID NO: 40702 - RNA, 21 nt, Homo sapiens
accagaaggaaccagcccugu

SEQ ID NO: 40703 - RNA, 21 nt, Homo sapiens
cccugcaaauggagaccugug

SEQ ID NO: 40704 - RNA, 19 nt, Homo sapiens
ccuggcacacaguaggagc

SEQ ID NO: 40705 - RNA, 24 nt, Homo sapiens
cuguaaacuaauaaauguguguug

SEQ ID NO: 40706 - RNA, 21 nt, Homo sapiens
gcuuggagagccaucuggucc

SEQ ID NO: 40707 - RNA, 24 nt, Homo sapiens
ggaaacucaagacggcggccuggc

SEQ ID NO: 40708 - RNA, 17 nt, Homo sapiens
aucaaacacccugcauu

SEQ ID NO: 40709 - RNA, 22 nt, Homo sapiens
ccuugaugcccgugccugugaa

SEQ ID NO: 40710 - RNA, 20 nt, Homo sapiens
acauguguacacagaucuca

SEQ ID NO: 40711 - RNA, 21 nt, Homo sapiens
ucucuaggagaaaucccguca

SEQ ID NO: 40712 - RNA, 20 nt, Homo sapiens
gugacagcaucauuugagug

SEQ ID NO: 40713 - RNA, 19 nt, Homo sapiens
aaaaaaaagcacuuaaugc

SEQ ID NO: 40714 - RNA, 21 nt, Homo sapiens
gcauguggcgugcucugggua

SEQ ID NO: 40715 - RNA, 18 nt, Homo sapiens
ggauaccagcucaguucc

SEQ ID NO: 40716 - RNA, 21 nt, Homo sapiens
ucccccauggaugagcccaaa

SEQ ID NO: 40717 - RNA, 18 nt, Homo sapiens
ucggaaggagcccccagg

SEQ ID NO: 40718 - RNA, 24 nt, Homo sapiens
ucucuucgcuagguccuggguuuu

SEQ ID NO: 40719 - RNA, 23 nt, Homo sapiens
cagcccuagcauguuguugcaua

SEQ ID NO: 40720 - RNA, 24 nt, Homo sapiens
ccacagaggcggaagaccagcgag

SEQ ID NO: 40721 - RNA, 17 nt, Homo sapiens
gaaccaggaggguggcc

SEQ ID NO: 40722 - RNA, 19 nt, Homo sapiens
ggccgccagaacugccucu

SEQ ID NO: 40723 - RNA, 19 nt, Homo sapiens
gaucggcacacauguguga

SEQ ID NO: 40724 - RNA, 20 nt, Homo sapiens
gccagguccccgggggguuc

SEQ ID NO: 40725 - RNA, 18 nt, Homo sapiens
acacuccaucuucacccu

SEQ ID NO: 40726 - RNA, 16 nt, Homo sapiens
aggucagugaagcuca

SEQ ID NO: 40727 - RNA, 21 nt, Homo sapiens
cccucccccacucccccaccu

SEQ ID NO: 40728 - RNA, 20 nt, Homo sapiens
cccuuccccacuucaccucc

SEQ ID NO: 40729 - RNA, 19 nt, Homo sapiens
ccuuccccacuucaccucc

SEQ ID NO: 40730 - RNA, 19 nt, Homo sapiens
gcuucaugaucucauuuua

SEQ ID NO: 40731 - RNA, 21 nt, Homo sapiens
gugaagcucagugcagcugca

SEQ ID NO: 40732 - RNA, 22 nt, Homo sapiens
uccaucuucacccuccauucca

SEQ ID NO: 40733 - RNA, 18 nt, Homo sapiens
caacaggagagccacuuu

SEQ ID NO: 40734 - RNA, 18 nt, Homo sapiens
ccuugggguuuugaucag

SEQ ID NO: 40735 - RNA, 19 nt, Homo sapiens
cugagucugggucuggguc

SEQ ID NO: 40736 - RNA, 17 nt, Homo sapiens
cuguuuugcuccauccc

SEQ ID NO: 40737 - RNA, 22 nt, Homo sapiens
gcuccugccaggagcucugaga

SEQ ID NO: 40738 - RNA, 21 nt, Homo sapiens
gcuugggucugagucuggguc

SEQ ID NO: 40739 - RNA, 19 nt, Homo sapiens
ggacagggaaagggccacc

SEQ ID NO: 40740 - RNA, 24 nt, Homo sapiens
ugaaugugagccgauaugcagcug

SEQ ID NO: 40741 - RNA, 20 nt, Homo sapiens
cugagauccuccucugcccu

SEQ ID NO: 40742 - RNA, 19 nt, Homo sapiens
gcuacaggaugaacaguga

SEQ ID NO: 40743 - RNA, 19 nt, Homo sapiens
ggccgggugcgguggcuca

SEQ ID NO: 40744 - RNA, 17 nt, Homo sapiens
guaaaaucuggaaaagg

SEQ ID NO: 40745 - RNA, 19 nt, Homo sapiens
auaugauacaccagagcug

SEQ ID NO: 40746 - RNA, 19 nt, Homo sapiens
ccugacagucccuugguuc

SEQ ID NO: 40747 - RNA, 26 nt, Homo sapiens
cucagcaggcacaggaagcgcugcca

SEQ ID NO: 40748 - RNA, 17 nt, Homo sapiens
gacaauucugccuucaa

SEQ ID NO: 40749 - RNA, 20 nt, Homo sapiens
gcuuccuguacauuuccuca

SEQ ID NO: 40750 - RNA, 23 nt, Homo sapiens
uccucuucuccuacaaauaccuc

SEQ ID NO: 40751 - RNA, 23 nt, Homo sapiens
uucaugaugcuucuagcauugga

SEQ ID NO: 40752 - RNA, 18 nt, Homo sapiens
caugguaaaacauuuaac

SEQ ID NO: 40753 - RNA, 18 nt, Homo sapiens
cccacaaccuccgccucc

SEQ ID NO: 40754 - RNA, 20 nt, Homo sapiens
cucuuucucucuuuuuccuc

SEQ ID NO: 40755 - RNA, 17 nt, Homo sapiens
gacccgaaaugaggcua

SEQ ID NO: 40756 - RNA, 22 nt, Homo sapiens
gccugauggugacuguugguuu

SEQ ID NO: 40757 - RNA, 19 nt, Homo sapiens
uuguuuaacugcacuggcu

SEQ ID NO: 40758 - RNA, 24 nt, Homo sapiens
uuuaaguagucuuacuuuuuauuu

SEQ ID NO: 40759 - RNA, 18 nt, Homo sapiens
ccccgccccacccccgca

SEQ ID NO: 40760 - RNA, 20 nt, Homo sapiens
uggcccagcucuuaggccaa

SEQ ID NO: 40761 - RNA, 20 nt, Homo sapiens
uggcugugguccugcagcaa

SEQ ID NO: 40762 - RNA, 19 nt, Homo sapiens
cguggugucucugaucucc

SEQ ID NO: 40763 - RNA, 18 nt, Homo sapiens
cugaaaguacacucuuuu

SEQ ID NO: 40764 - RNA, 23 nt, Homo sapiens
acacaggagggcugcuaaucaca

SEQ ID NO: 40765 - RNA, 22 nt, Homo sapiens
uacacaggagggcugcuaauca

SEQ ID NO: 40766 - RNA, 17 nt, Homo sapiens
agaaaagaaagcaaacg

SEQ ID NO: 40767 - RNA, 19 nt, Homo sapiens
cugcaaccuccaccucuca

SEQ ID NO: 40768 - RNA, 22 nt, Homo sapiens
cuugagcuacuuagucacuuuu

SEQ ID NO: 40769 - RNA, 18 nt, Homo sapiens
uccaccucucagguucaa

SEQ ID NO: 40770 - RNA, 21 nt, Homo sapiens
aauacaaaaaguauguuugua

SEQ ID NO: 40771 - RNA, 23 nt, Homo sapiens
acagcgcugccugcaaaauagac

SEQ ID NO: 40772 - RNA, 17 nt, Homo sapiens
gcuccuuaacaccaaca

SEQ ID NO: 40773 - RNA, 18 nt, Homo sapiens
gugacuagacucauuucc

SEQ ID NO: 40774 - RNA, 19 nt, Homo sapiens
ucaccaccacaccaugcca

SEQ ID NO: 40775 - RNA, 20 nt, Homo sapiens
ucaccauguccuuaaaccau

SEQ ID NO: 40776 - RNA, 23 nt, Homo sapiens
gccuggaccguuggagugggucc

SEQ ID NO: 40777 - RNA, 17 nt, Homo sapiens
caggccuccucuccccc

SEQ ID NO: 40778 - RNA, 20 nt, Homo sapiens
cgcuucuagccccucucuca

SEQ ID NO: 40779 - RNA, 20 nt, Homo sapiens
cugguucucuccauuccucc

SEQ ID NO: 40780 - RNA, 21 nt, Homo sapiens
agcuccuccugcagcucaaca

SEQ ID NO: 40781 - RNA, 22 nt, Homo sapiens
uugaauguaacuuccucacuca

SEQ ID NO: 40782 - RNA, 22 nt, Homo sapiens
caaaggauuaauaauuaaccua

SEQ ID NO: 40783 - RNA, 24 nt, Homo sapiens
ccuuccccugugcccuucgcccca

SEQ ID NO: 40784 - RNA, 21 nt, Homo sapiens
gcuugagucgugagggccugg

SEQ ID NO: 40785 - RNA, 19 nt, Homo sapiens
ugccggaccugguggggag

SEQ ID NO: 40786 - RNA, 22 nt, Homo sapiens
aggaaaccccaucaaggaccga

SEQ ID NO: 40787 - RNA, 24 nt, Homo sapiens
uccagugagccuccuucaacuccu

SEQ ID NO: 40788 - RNA, 19 nt, Homo sapiens
cacacgcaggugugcaagg

SEQ ID NO: 40789 - RNA, 24 nt, Homo sapiens
cccuggugacaccuugaucuugga

SEQ ID NO: 40790 - RNA, 18 nt, Homo sapiens
ccguggaagaguugucuu

SEQ ID NO: 40791 - RNA, 21 nt, Homo sapiens
cuguaggacacacacacacac

SEQ ID NO: 40792 - RNA, 19 nt, Homo sapiens
cugucucaucacugccaga

SEQ ID NO: 40793 - RNA, 19 nt, Homo sapiens
gcacgugcgcacacacaca

SEQ ID NO: 40794 - RNA, 21 nt, Homo sapiens
gccccagcuguugccuggcuu

SEQ ID NO: 40795 - RNA, 20 nt, Homo sapiens
gucacccggcagcaaacacg

SEQ ID NO: 40796 - RNA, 16 nt, Homo sapiens
acaagugaucaaaccu

SEQ ID NO: 40797 - RNA, 18 nt, Homo sapiens
caccauucuccugccuca

SEQ ID NO: 40798 - RNA, 20 nt, Homo sapiens
aggcucugaagcacucccca

SEQ ID NO: 40799 - RNA, 17 nt, Homo sapiens
cagguucaaugacuugc

SEQ ID NO: 40800 - RNA, 19 nt, Homo sapiens
ccagcugagccccuccuuu

SEQ ID NO: 40801 - RNA, 21 nt, Homo sapiens
ccucuucaccucaugcugucu

SEQ ID NO: 40802 - RNA, 19 nt, Homo sapiens
cuuugcaacaaccuaccca

SEQ ID NO: 40803 - RNA, 22 nt, Homo sapiens
gcacaaggucacauagcuuuua

SEQ ID NO: 40804 - RNA, 18 nt, Homo sapiens
guaaguuuauaagaggag

SEQ ID NO: 40805 - RNA, 21 nt, Homo sapiens
ucaguuccuuucucuguuccu

SEQ ID NO: 40806 - RNA, 20 nt, Homo sapiens
ugguuuucucuuagguccaa

SEQ ID NO: 40807 - RNA, 17 nt, Homo sapiens
caaaugccccacgguag

SEQ ID NO: 40808 - RNA, 23 nt, Homo sapiens
cgcggggugccgcagcuccacca

SEQ ID NO: 40809 - RNA, 17 nt, Homo sapiens
cuggggugugacuuuga

SEQ ID NO: 40810 - RNA, 23 nt, Homo sapiens
gcuugagccgccgggccuugucc

SEQ ID NO: 40811 - RNA, 21 nt, Homo sapiens
uggaugggccccaccgcgggg

SEQ ID NO: 40812 - RNA, 19 nt, Homo sapiens
acugaggaugaacuguguu

SEQ ID NO: 40813 - RNA, 21 nt, Homo sapiens
cccacuuuccagaccauucca

SEQ ID NO: 40814 - RNA, 25 nt, Homo sapiens
cuguguuuugcagcauuuuguuuua

SEQ ID NO: 40815 - RNA, 21 nt, Homo sapiens
uccuggcaggaggaccuggag

SEQ ID NO: 40816 - RNA, 24 nt, Homo sapiens
gacagaccaugauuaggucuguca

SEQ ID NO: 40817 - RNA, 18 nt, Homo sapiens
ucaccccauggcuuccca

SEQ ID NO: 40818 - RNA, 24 nt, Homo sapiens
ugcugucuacaggagcucauccca

SEQ ID NO: 40819 - RNA, 20 nt, Homo sapiens
uugaaacccagauuuaccuc

SEQ ID NO: 40820 - RNA, 16 nt, Homo sapiens
aggcaaugaauuacuu

SEQ ID NO: 40821 - RNA, 20 nt, Homo sapiens
ccguguuuuggucaaacgua

SEQ ID NO: 40822 - RNA, 19 nt, Homo sapiens
ccuguaucaugaaaacuga

SEQ ID NO: 40823 - RNA, 19 nt, Homo sapiens
uaucgugcauguucguggu

SEQ ID NO: 40824 - RNA, 23 nt, Homo sapiens
uguaccauaugugaaacauucug

SEQ ID NO: 40825 - RNA, 19 nt, Homo sapiens
aauuucgcagaaugugaua

SEQ ID NO: 40826 - RNA, 19 nt, Homo sapiens
cauuaaacagggguagcgu

SEQ ID NO: 40827 - RNA, 22 nt, Homo sapiens
gcgcugugacccuucugccucc

SEQ ID NO: 40828 - RNA, 21 nt, Homo sapiens
ucuuuuucaccuuuucuugua

SEQ ID NO: 40829 - RNA, 19 nt, Homo sapiens
uuuccucuuaaaacgggug

SEQ ID NO: 40830 - RNA, 21 nt, Homo sapiens
accaucaugucuuccuuugug

SEQ ID NO: 40831 - RNA, 19 nt, Homo sapiens
cacuucccuccccaaguaa

SEQ ID NO: 40832 - RNA, 18 nt, Homo sapiens
uauaugcauuugucuaug

SEQ ID NO: 40833 - RNA, 17 nt, Homo sapiens
accguggccucugguuu

SEQ ID NO: 40834 - RNA, 24 nt, Homo sapiens
cuccgugguguaaugaagucccag

SEQ ID NO: 40835 - RNA, 23 nt, Homo sapiens
cuuuacuugguugccauaauuuu

SEQ ID NO: 40836 - RNA, 19 nt, Homo sapiens
gcuaugugcaaauguagua

SEQ ID NO: 40837 - RNA, 15 nt, Homo sapiens
uaccagugucagaua

SEQ ID NO: 40838 - RNA, 17 nt, Homo sapiens
uguuaauaagagcauug

SEQ ID NO: 40839 - RNA, 21 nt, Homo sapiens
ccgccuccgccaggccuccug

SEQ ID NO: 40840 - RNA, 20 nt, Homo sapiens
uugcguggaaaaguaucugu

SEQ ID NO: 40841 - RNA, 24 nt, Homo sapiens
uuuccaaaccaggauuccuuacua

SEQ ID NO: 40842 - RNA, 17 nt, Homo sapiens
caauccucugaccacug

SEQ ID NO: 40843 - RNA, 23 nt, Homo sapiens
ccugggccaguugauuugaccuu

SEQ ID NO: 40844 - RNA, 23 nt, Homo sapiens
ccucuucgucacucccuggcuuu

SEQ ID NO: 40845 - RNA, 16 nt, Homo sapiens
gcuuuggcuguuuugu

SEQ ID NO: 40846 - RNA, 18 nt, Homo sapiens
gcuuuggcuguuuugucu

SEQ ID NO: 40847 - RNA, 24 nt, Homo sapiens
ccacugcuggguaucugucagcaa

SEQ ID NO: 40848 - RNA, 20 nt, Homo sapiens
ucccacugcuggguaucugu

SEQ ID NO: 40849 - RNA, 23 nt, Homo sapiens
aaugguaucuaacucuguuccuu

SEQ ID NO: 40850 - RNA, 18 nt, Homo sapiens
agaaauuguaacagcaug

SEQ ID NO: 40851 - RNA, 21 nt, Homo sapiens
ucuguacugauugaugugcuu

SEQ ID NO: 40852 - RNA, 25 nt, Homo sapiens
uuaguguggucuuuaaguugcuuuu

SEQ ID NO: 40853 - RNA, 20 nt, Homo sapiens
caccaccaccaucccccucu

SEQ ID NO: 40854 - RNA, 22 nt, Homo sapiens
cgccuccugggcaagcucccca

SEQ ID NO: 40855 - RNA, 19 nt, Homo sapiens
uccagaagcuggacugcag

SEQ ID NO: 40856 - RNA, 18 nt, Homo sapiens
ucccauacaucuguccaa

SEQ ID NO: 40857 - RNA, 23 nt, Homo sapiens
augcugaguguggccgcgccuua

SEQ ID NO: 40858 - RNA, 24 nt, Homo sapiens
cucccaccccuccuccccgcgcca

SEQ ID NO: 40859 - RNA, 21 nt, Homo sapiens
ugccccugggcucccaucucu

SEQ ID NO: 40860 - RNA, 24 nt, Homo sapiens
aagagaggcaagagaaagcucugg

SEQ ID NO: 40861 - RNA, 19 nt, Homo sapiens
gggaggugguggccacggc

SEQ ID NO: 40862 - RNA, 20 nt, Homo sapiens
aaauaacuuuuguguuuauu

SEQ ID NO: 40863 - RNA, 22 nt, Homo sapiens
gauuguuuugugaaacuuuuaa

SEQ ID NO: 40864 - RNA, 21 nt, Homo sapiens
uuaacuuauuccauuuauuua

SEQ ID NO: 40865 - RNA, 25 nt, Homo sapiens
cacuccugaccucagacucacuucc

SEQ ID NO: 40866 - RNA, 17 nt, Homo sapiens
ccccacuccugaccuca

SEQ ID NO: 40867 - RNA, 15 nt, Homo sapiens
aggauuauaucuuga

SEQ ID NO: 40868 - RNA, 20 nt, Homo sapiens
ugcccaugguguccucaagc

SEQ ID NO: 40869 - RNA, 22 nt, Homo sapiens
cgcagagcaagggcggcaagga

SEQ ID NO: 40870 - RNA, 19 nt, Homo sapiens
aagcaauucuccugccuca

SEQ ID NO: 40871 - RNA, 21 nt, Homo sapiens
agaaauaaucuugcucuguca

SEQ ID NO: 40872 - RNA, 17 nt, Homo sapiens
aggaaauaaugauuggc

SEQ ID NO: 40873 - RNA, 18 nt, Homo sapiens
ccuccuccucuuucuuca

SEQ ID NO: 40874 - RNA, 21 nt, Homo sapiens
ccuuuucauagagcgcuguuu

SEQ ID NO: 40875 - RNA, 19 nt, Homo sapiens
cuuucuuuuaaaagaggua

SEQ ID NO: 40876 - RNA, 19 nt, Homo sapiens
gacuuuggcuguuuaauca

SEQ ID NO: 40877 - RNA, 26 nt, Homo sapiens
gcccucuccucuaaccuauaaacuga

SEQ ID NO: 40878 - RNA, 23 nt, Homo sapiens
gcuucccuuuucuccucuccucu

SEQ ID NO: 40879 - RNA, 24 nt, Homo sapiens
uauuuauagauauauucuaugaga

SEQ ID NO: 40880 - RNA, 16 nt, Homo sapiens
uugagucauaaguacc

SEQ ID NO: 40881 - RNA, 19 nt, Homo sapiens
cggauccaagguccugccu

SEQ ID NO: 40882 - RNA, 24 nt, Homo sapiens
uggguggacuccagccuccccagc

SEQ ID NO: 40883 - RNA, 20 nt, Homo sapiens
aaggaucaccucacuuccug

SEQ ID NO: 40884 - RNA, 21 nt, Homo sapiens
aacauaugaauauucacacca

SEQ ID NO: 40885 - RNA, 20 nt, Homo sapiens
ucugucuuucccaugagccu

SEQ ID NO: 40886 - RNA, 22 nt, Homo sapiens
ccugggcauuucaagugcuuuu

SEQ ID NO: 40887 - RNA, 19 nt, Homo sapiens
uaccagcuacugugccaga

SEQ ID NO: 40888 - RNA, 26 nt, Homo sapiens
uccaccgacaccugcuucuucccuca

SEQ ID NO: 40889 - RNA, 18 nt, Homo sapiens
aaucacauccucucuccu

SEQ ID NO: 40890 - RNA, 24 nt, Homo sapiens
gacaaagaggccucuuccaaccca

SEQ ID NO: 40891 - RNA, 17 nt, Homo sapiens
uccauucuaugcaccuc

SEQ ID NO: 40892 - RNA, 19 nt, Homo sapiens
cacgggucugacacgucug

SEQ ID NO: 40893 - RNA, 18 nt, Homo sapiens
gcaagaagguaggguugc

SEQ ID NO: 40894 - RNA, 23 nt, Homo sapiens
cucuguagugugagggucugugg

SEQ ID NO: 40895 - RNA, 23 nt, Homo sapiens
ugcuuggcaaugcucuccaucuc

SEQ ID NO: 40896 - RNA, 18 nt, Homo sapiens
ccucugugaaaggaguua

SEQ ID NO: 40897 - RNA, 23 nt, Homo sapiens
guauuaacauucuccaucuaaua

SEQ ID NO: 40898 - RNA, 17 nt, Homo sapiens
ucagcaagccuugguug

SEQ ID NO: 40899 - RNA, 17 nt, Homo sapiens
ggucgcgcgguaccugc

SEQ ID NO: 40900 - RNA, 18 nt, Homo sapiens
uccccggacuccggccag

SEQ ID NO: 40901 - RNA, 21 nt, Homo sapiens
acacacucaaauucuuuaauc

SEQ ID NO: 40902 - RNA, 23 nt, Homo sapiens
cacugaguaccuaccaugugcca

SEQ ID NO: 40903 - RNA, 25 nt, Homo sapiens
ccuggcacuaugauccaguugcugc

SEQ ID NO: 40904 - RNA, 21 nt, Homo sapiens
cucccaaaggcagcccaccac

SEQ ID NO: 40905 - RNA, 24 nt, Homo sapiens
aaauguagaugccuccaugaguuc

SEQ ID NO: 40906 - RNA, 20 nt, Homo sapiens
agaagggaugaauguuaagc

SEQ ID NO: 40907 - RNA, 18 nt, Homo sapiens
aguaagaugcauuucaca

SEQ ID NO: 40908 - RNA, 21 nt, Homo sapiens
caugguaagaaaggaaugcaa

SEQ ID NO: 40909 - RNA, 18 nt, Homo sapiens
guuuuaccuuuuugcuua

SEQ ID NO: 40910 - RNA, 21 nt, Homo sapiens
uuuguuuguuuccuuuguggu

SEQ ID NO: 40911 - RNA, 19 nt, Homo sapiens
uggaugcccagggcgcuga

SEQ ID NO: 40912 - RNA, 19 nt, Homo sapiens
ugggugggcucugccagag

SEQ ID NO: 40913 - RNA, 20 nt, Homo sapiens
uggucaggcuggucuugaac

SEQ ID NO: 40914 - RNA, 17 nt, Homo sapiens
acagaagggcgccaagc

SEQ ID NO: 40915 - RNA, 24 nt, Homo sapiens
acugaggugugacuguuuggaccc

SEQ ID NO: 40916 - RNA, 20 nt, Homo sapiens
auugcagaaaauaacauugu

SEQ ID NO: 40917 - RNA, 21 nt, Homo sapiens
caaccccagcucucucugcuc

SEQ ID NO: 40918 - RNA, 17 nt, Homo sapiens
gaccuggcuccuggcuu

SEQ ID NO: 40919 - RNA, 21 nt, Homo sapiens
gcuuuuuuugccacucugaua

SEQ ID NO: 40920 - RNA, 18 nt, Homo sapiens
gucuccuggaagcagagc

SEQ ID NO: 40921 - RNA, 16 nt, Homo sapiens
ucaagacuuccuccag

SEQ ID NO: 40922 - RNA, 17 nt, Homo sapiens
agccucuguaaucaugu

SEQ ID NO: 40923 - RNA, 22 nt, Homo sapiens
caugcguugugggagggaccca

SEQ ID NO: 40924 - RNA, 20 nt, Homo sapiens
gugacuugcuccucauugcc

SEQ ID NO: 40925 - RNA, 20 nt, Homo sapiens
uccugauucugaggcuuugg

SEQ ID NO: 40926 - RNA, 25 nt, Homo sapiens
ucucugcacaagcugucuuugucuu

SEQ ID NO: 40927 - RNA, 24 nt, Homo sapiens
uggguggaaugauaggguuugguu

SEQ ID NO: 40928 - RNA, 19 nt, Homo sapiens
ugucucuuuggcgaacccu

SEQ ID NO: 40929 - RNA, 17 nt, Homo sapiens
agccucuguaaucaugu

SEQ ID NO: 40930 - RNA, 22 nt, Homo sapiens
caugcguugugggagggaccca

SEQ ID NO: 40931 - RNA, 20 nt, Homo sapiens
gugacuugcuccucauugcc

SEQ ID NO: 40932 - RNA, 20 nt, Homo sapiens
uccugauucugagacuuugg

SEQ ID NO: 40933 - RNA, 25 nt, Homo sapiens
ucucugcacaagcugucuuugucuu

SEQ ID NO: 40934 - RNA, 24 nt, Homo sapiens
uggguggaaugauaggguuugguu

SEQ ID NO: 40935 - RNA, 25 nt, Homo sapiens
aaaguaaugucguauuauuucccca

SEQ ID NO: 40936 - RNA, 18 nt, Homo sapiens
caccaccgccuccgcucu

SEQ ID NO: 40937 - RNA, 21 nt, Homo sapiens
cauucauggaacuuauuagug

SEQ ID NO: 40938 - RNA, 18 nt, Homo sapiens
ccaccaccgccuccgcuc

SEQ ID NO: 40939 - RNA, 21 nt, Homo sapiens
cucaugucauccuccucuauc

SEQ ID NO: 40940 - RNA, 20 nt, Homo sapiens
ggaacgagcaaugauugcca

SEQ ID NO: 40941 - RNA, 22 nt, Homo sapiens
uauuccagaagcucuuuucuga

SEQ ID NO: 40942 - RNA, 22 nt, Homo sapiens
cccucugacgggagaucugggg

SEQ ID NO: 40943 - RNA, 22 nt, Homo sapiens
aacucauuugggcaaaacucaa

SEQ ID NO: 40944 - RNA, 25 nt, Homo sapiens
ccuuuuuguguggugcccuugguuu

SEQ ID NO: 40945 - RNA, 25 nt, Homo sapiens
aagagcuauucccccgaguccacca

SEQ ID NO: 40946 - RNA, 16 nt, Homo sapiens
gugggccaggauggca

SEQ ID NO: 40947 - RNA, 22 nt, Homo sapiens
ugggugggccaggauggcacug

SEQ ID NO: 40948 - RNA, 18 nt, Homo sapiens
acacgagcacucugggug

SEQ ID NO: 40949 - RNA, 23 nt, Homo sapiens
ccuucaaaacauacucaucucca

SEQ ID NO: 40950 - RNA, 18 nt, Homo sapiens
gaguggaguauggggcug

SEQ ID NO: 40951 - RNA, 19 nt, Homo sapiens
uaaaaacaucgugaaugaa

SEQ ID NO: 40952 - RNA, 20 nt, Homo sapiens
uugcaugcuuccaagccuuc

SEQ ID NO: 40953 - RNA, 22 nt, Homo sapiens
aucucggcucacugcgaccucu

SEQ ID NO: 40954 - RNA, 21 nt, Homo sapiens
ccuuaaugaaacaguauccaa

SEQ ID NO: 40955 - RNA, 21 nt, Homo sapiens
uccuccaaaccaaauacagca

SEQ ID NO: 40956 - RNA, 25 nt, Homo sapiens
acagagggguccacacccagugcac

SEQ ID NO: 40957 - RNA, 20 nt, Homo sapiens
cgucugugaugugggcaccu

SEQ ID NO: 40958 - RNA, 22 nt, Homo sapiens
cugugaccaugaggcccagcug

SEQ ID NO: 40959 - RNA, 21 nt, Homo sapiens
gaagaaauguccggcauuuuu

SEQ ID NO: 40960 - RNA, 27 nt, Homo sapiens
ugccacgucugugaugugggcaccuca

SEQ ID NO: 40961 - RNA, 26 nt, Homo sapiens
aaaccauuuagaaaauaccaauaacc

SEQ ID NO: 40962 - RNA, 19 nt, Homo sapiens
auugacuggauuuuuccca

SEQ ID NO: 40963 - RNA, 19 nt, Homo sapiens
caacugaugauaacuguga

SEQ ID NO: 40964 - RNA, 18 nt, Homo sapiens
ccagucaacaugaauggg

SEQ ID NO: 40965 - RNA, 19 nt, Homo sapiens
gagucacagaucugagaaa

SEQ ID NO: 40966 - RNA, 18 nt, Homo sapiens
ugggcauugguauggaau

SEQ ID NO: 40967 - RNA, 19 nt, Homo sapiens
aagccaucaaaucucguga

SEQ ID NO: 40968 - RNA, 18 nt, Homo sapiens
accgcccccaugauucaa

SEQ ID NO: 40969 - RNA, 18 nt, Homo sapiens
acuugggccuggagucug

SEQ ID NO: 40970 - RNA, 20 nt, Homo sapiens
cugcucugggaaugcugcuu

SEQ ID NO: 40971 - RNA, 26 nt, Homo sapiens
gcgucccagaaccacccgcucucucu

SEQ ID NO: 40972 - RNA, 19 nt, Homo sapiens
uggguggggcacaugggac

SEQ ID NO: 40973 - RNA, 22 nt, Homo sapiens
aacacaaaaugugggcauucug

SEQ ID NO: 40974 - RNA, 24 nt, Homo sapiens
acccaggaugagcaaaaggauccc

SEQ ID NO: 40975 - RNA, 18 nt, Homo sapiens
ccuccuacucagcacaca

SEQ ID NO: 40976 - RNA, 19 nt, Homo sapiens
gcugaugcuggugggcuuu

SEQ ID NO: 40977 - RNA, 26 nt, Homo sapiens
ucugaauguuguguauguggcugaua

SEQ ID NO: 40978 - RNA, 18 nt, Homo sapiens
ucugauuugguuuugugg

SEQ ID NO: 40979 - RNA, 20 nt, Homo sapiens
cgcgcgggcccccgcgcugc

SEQ ID NO: 40980 - RNA, 22 nt, Homo sapiens
accugaauuuuauuucuggcuu

SEQ ID NO: 40981 - RNA, 21 nt, Homo sapiens
gccugacauggucccuggcuc

SEQ ID NO: 40982 - RNA, 22 nt, Homo sapiens
uuucuggcuuugccucuuacca

SEQ ID NO: 40983 - RNA, 21 nt, Homo sapiens
uuugggugauccugauuuuau

SEQ ID NO: 40984 - RNA, 17 nt, Homo sapiens
acaacgccauccgcucc

SEQ ID NO: 40985 - RNA, 22 nt, Homo sapiens
agggaaaugcaaaucaaaacua

SEQ ID NO: 40986 - RNA, 17 nt, Homo sapiens
guguguuggacuuucca

SEQ ID NO: 40987 - RNA, 20 nt, Homo sapiens
uauaauccagagacugagaa

SEQ ID NO: 40988 - RNA, 19 nt, Homo sapiens
aucacccccugcuacauca

SEQ ID NO: 40989 - RNA, 22 nt, Homo sapiens
acaaaacaaaacaaaacccuca

SEQ ID NO: 40990 - RNA, 17 nt, Homo sapiens
ucccucccaccacccca

SEQ ID NO: 40991 - RNA, 18 nt, Homo sapiens
ugaauuucuucugccagu

SEQ ID NO: 40992 - RNA, 24 nt, Homo sapiens
gccagggaagcugugaccccagua

SEQ ID NO: 40993 - RNA, 20 nt, Homo sapiens
gcccuggcaggcagccaggg

SEQ ID NO: 40994 - RNA, 24 nt, Homo sapiens
ucaucaucaucaucauccucaucc

SEQ ID NO: 40995 - RNA, 18 nt, Homo sapiens
uggguggaucaccugagg

SEQ ID NO: 40996 - RNA, 21 nt, Homo sapiens
uggguggauugcuugagucua

SEQ ID NO: 40997 - RNA, 22 nt, Homo sapiens
uuucccacuggaguucucugaa

SEQ ID NO: 40998 - RNA, 21 nt, Homo sapiens
ugcagucagccaagaucgugc

SEQ ID NO: 40999 - RNA, 16 nt, Homo sapiens
acugacaccagugugc

SEQ ID NO: 41000 - RNA, 18 nt, Homo sapiens
acugcaacuuccaccucc

SEQ ID NO: 41001 - RNA, 18 nt, Homo sapiens
agacagagguuucccccu

SEQ ID NO: 41002 - RNA, 25 nt, Homo sapiens
aggcuuuuaaucccuuaaucccucu

SEQ ID NO: 41003 - RNA, 16 nt, Homo sapiens
auuugccuccauccca

SEQ ID NO: 41004 - RNA, 23 nt, Homo sapiens
cauuuuucuccaccccaacuuca

SEQ ID NO: 41005 - RNA, 18 nt, Homo sapiens
ccaaaagccaccucugaa

SEQ ID NO: 41006 - RNA, 20 nt, Homo sapiens
ccucugccuccuggguucaa

SEQ ID NO: 41007 - RNA, 23 nt, Homo sapiens
cggguucaagcgauccugccuca

SEQ ID NO: 41008 - RNA, 24 nt, Homo sapiens
cucuggcgauaaucacccugagag

SEQ ID NO: 41009 - RNA, 22 nt, Homo sapiens
gcaagaagagcagcgccuggca

SEQ ID NO: 41010 - RNA, 19 nt, Homo sapiens
ggccaacacacauggccaa

SEQ ID NO: 41011 - RNA, 21 nt, Homo sapiens
ucccauuuaauaacuauaaua

SEQ ID NO: 41012 - RNA, 20 nt, Homo sapiens
aacguucacccaacuuguca

SEQ ID NO: 41013 - RNA, 22 nt, Homo sapiens
acagcucagaaaggagagguga

SEQ ID NO: 41014 - RNA, 23 nt, Homo sapiens
acaguaucagauugagugagcuu

SEQ ID NO: 41015 - RNA, 20 nt, Homo sapiens
ccaugcucaggcccaccucc

SEQ ID NO: 41016 - RNA, 22 nt, Homo sapiens
gauccugggccccaggugguga

SEQ ID NO: 41017 - RNA, 22 nt, Homo sapiens
ucaguucauugaccagaugaca

SEQ ID NO: 41018 - RNA, 18 nt, Homo sapiens
ugguuucucaacaugagg

SEQ ID NO: 41019 - RNA, 21 nt, Homo sapiens
uguagcuugugccugugggug

SEQ ID NO: 41020 - RNA, 19 nt, Homo sapiens
aagcaauucuccugcccca

SEQ ID NO: 41021 - RNA, 18 nt, Homo sapiens
caugcacuucugcagggg

SEQ ID NO: 41022 - RNA, 20 nt, Homo sapiens
ccugcccucccagccacacc

SEQ ID NO: 41023 - RNA, 17 nt, Homo sapiens
ucaagugauucuccugc

SEQ ID NO: 41024 - RNA, 20 nt, Homo sapiens
ucaccacaaccuccaccucc

SEQ ID NO: 41025 - RNA, 18 nt, Homo sapiens
uccaccucccagguucaa

SEQ ID NO: 41026 - RNA, 18 nt, Homo sapiens
uccauauacagucacauc

SEQ ID NO: 41027 - RNA, 18 nt, Homo sapiens
aucauuauaacaucuuca

SEQ ID NO: 41028 - RNA, 20 nt, Homo sapiens
ucucuacaugaagucugugg

SEQ ID NO: 41029 - RNA, 20 nt, Homo sapiens
cgaggccgccugacgccuca

SEQ ID NO: 41030 - RNA, 20 nt, Homo sapiens
ggcuucuguaggugcuccca

SEQ ID NO: 41031 - RNA, 21 nt, Homo sapiens
uccggcugucauguccuguga

SEQ ID NO: 41032 - RNA, 21 nt, Homo sapiens
ccaggacccaggcccgccucc

SEQ ID NO: 41033 - RNA, 26 nt, Homo sapiens
ccgccuggcuuugggggucccggagg

SEQ ID NO: 41034 - RNA, 21 nt, Homo sapiens
cuguggugcaccgccuggcuu

SEQ ID NO: 41035 - RNA, 19 nt, Homo sapiens
ugggauuuccgaggcccag

SEQ ID NO: 41036 - RNA, 17 nt, Homo sapiens
uguuuguauuuuggugu

SEQ ID NO: 41037 - RNA, 19 nt, Homo sapiens
ugacgggagauuugcugag

SEQ ID NO: 41038 - RNA, 22 nt, Homo sapiens
caagagucuugagguucaguca

SEQ ID NO: 41039 - RNA, 18 nt, Homo sapiens
caagaguugggccagguu

SEQ ID NO: 41040 - RNA, 18 nt, Homo sapiens
ucauugcuucuuggccuu

SEQ ID NO: 41041 - RNA, 17 nt, Homo sapiens
uggaugggucccugaaa

SEQ ID NO: 41042 - RNA, 18 nt, Homo sapiens
gauaaauuguaagugcua

SEQ ID NO: 41043 - RNA, 18 nt, Homo sapiens
guucaugaucugcaccug

SEQ ID NO: 41044 - RNA, 21 nt, Homo sapiens
ucugaauauacauuauaugaa

SEQ ID NO: 41045 - RNA, 21 nt, Homo sapiens
ugaauggguauuuugugaaau

SEQ ID NO: 41046 - RNA, 19 nt, Homo sapiens
uuuugauaaauuguaagug

SEQ ID NO: 41047 - RNA, 24 nt, Homo sapiens
aucugaguuggccaagccaggcuc

SEQ ID NO: 41048 - RNA, 19 nt, Homo sapiens
cuuccucuccccugccucu

SEQ ID NO: 41049 - RNA, 18 nt, Homo sapiens
gggcuccagcagaggcug

SEQ ID NO: 41050 - RNA, 19 nt, Homo sapiens
guuaucaaaucucauccaa

SEQ ID NO: 41051 - RNA, 19 nt, Homo sapiens
aaagcaauauucuguguca

SEQ ID NO: 41052 - RNA, 21 nt, Homo sapiens
agccaagacuaugccacugca

SEQ ID NO: 41053 - RNA, 18 nt, Homo sapiens
gcugcugcuguggauucu

SEQ ID NO: 41054 - RNA, 21 nt, Homo sapiens
uaacuguguugcaucauccuc

SEQ ID NO: 41055 - RNA, 18 nt, Homo sapiens
uccaacauucauguaaua

SEQ ID NO: 41056 - RNA, 20 nt, Homo sapiens
aacagggcagagccuggcug

SEQ ID NO: 41057 - RNA, 20 nt, Homo sapiens
agggcagagccuggcugucc

SEQ ID NO: 41058 - RNA, 22 nt, Homo sapiens
ccaagggauggggguuugggga

SEQ ID NO: 41059 - RNA, 21 nt, Homo sapiens
cccauaccuccuccucccuuc

SEQ ID NO: 41060 - RNA, 22 nt, Homo sapiens
gagccaggagagcgccuucucu

SEQ ID NO: 41061 - RNA, 19 nt, Homo sapiens
gcccagagcucacucuuuu

SEQ ID NO: 41062 - RNA, 25 nt, Homo sapiens
agaccccgaggucugcuggauucca

SEQ ID NO: 41063 - RNA, 21 nt, Homo sapiens
cccgaggucugcuggauucca

SEQ ID NO: 41064 - RNA, 18 nt, Homo sapiens
ucuaccucccagguucaa

SEQ ID NO: 41065 - RNA, 19 nt, Homo sapiens
aaacauaaaccaguaccuc

SEQ ID NO: 41066 - RNA, 19 nt, Homo sapiens
aaacuccugaccucaggug

SEQ ID NO: 41067 - RNA, 18 nt, Homo sapiens
aagguucuaagguucagu

SEQ ID NO: 41068 - RNA, 23 nt, Homo sapiens
aauauugaaugauguuacuuuga

SEQ ID NO: 41069 - RNA, 25 nt, Homo sapiens
aguaauuuuuaaauauuucaucuua

SEQ ID NO: 41070 - RNA, 20 nt, Homo sapiens
cagcugccacccugaucuga

SEQ ID NO: 41071 - RNA, 18 nt, Homo sapiens
gaccucacaaacaucuca

SEQ ID NO: 41072 - RNA, 25 nt, Homo sapiens
gucaaaaaagguuucugcccacgca

SEQ ID NO: 41073 - RNA, 22 nt, Homo sapiens
uacauucauguuuccacccacc

SEQ ID NO: 41074 - RNA, 22 nt, Homo sapiens
ucaaagccaguaauucauagca

SEQ ID NO: 41075 - RNA, 17 nt, Homo sapiens
ucaagugauucuccugc

SEQ ID NO: 41076 - RNA, 20 nt, Homo sapiens
ugggaccugacuugaaacua

SEQ ID NO: 41077 - RNA, 20 nt, Homo sapiens
aaccuuaacauccccuacag

SEQ ID NO: 41078 - RNA, 19 nt, Homo sapiens
acacugccaccacccugca

SEQ ID NO: 41079 - RNA, 19 nt, Homo sapiens
acugccaccacccugcaca

SEQ ID NO: 41080 - RNA, 18 nt, Homo sapiens
cuuugaaggaaugguguu

SEQ ID NO: 41081 - RNA, 24 nt, Homo sapiens
gaaccaggagaagaugguuguggg

SEQ ID NO: 41082 - RNA, 20 nt, Homo sapiens
gaugggauugucagccacca

SEQ ID NO: 41083 - RNA, 18 nt, Homo sapiens
gcuucuguggauuucuau

SEQ ID NO: 41084 - RNA, 18 nt, Homo sapiens
auguaaacgcccaccuua

SEQ ID NO: 41085 - RNA, 18 nt, Homo sapiens
guuuuaaauaggcuuuaa

SEQ ID NO: 41086 - RNA, 20 nt, Homo sapiens
cuccccauaccucugucucu

SEQ ID NO: 41087 - RNA, 19 nt, Homo sapiens
ggcagcaagcacuaagcug

SEQ ID NO: 41088 - RNA, 18 nt, Homo sapiens
agagaggugucaauucug

SEQ ID NO: 41089 - RNA, 17 nt, Homo sapiens
agcagcagcaacuaguc

SEQ ID NO: 41090 - RNA, 16 nt, Homo sapiens
cauaucccacauucuc

SEQ ID NO: 41091 - RNA, 17 nt, Homo sapiens
gacauuuccuagugcuu

SEQ ID NO: 41092 - RNA, 17 nt, Homo sapiens
uccaacccauaggucac

SEQ ID NO: 41093 - RNA, 21 nt, Homo sapiens
uccagguuccaauaucaaaca

SEQ ID NO: 41094 - RNA, 22 nt, Homo sapiens
aucccaagugggcccaaagcua

SEQ ID NO: 41095 - RNA, 24 nt, Homo sapiens
ugagagaugaacauacacaucucu

SEQ ID NO: 41096 - RNA, 19 nt, Homo sapiens
acucucugaccuccucacc

SEQ ID NO: 41097 - RNA, 18 nt, Homo sapiens
agccuucaacaauggcac

SEQ ID NO: 41098 - RNA, 22 nt, Homo sapiens
agccuucaacaauggcaccauc

SEQ ID NO: 41099 - RNA, 22 nt, Homo sapiens
cugugaauguauaauuuugauu

SEQ ID NO: 41100 - RNA, 23 nt, Homo sapiens
gucauggaaaucccagcuaugca

SEQ ID NO: 41101 - RNA, 19 nt, Homo sapiens
uccccucuguuucccacua

SEQ ID NO: 41102 - RNA, 21 nt, Homo sapiens
ucugaaaauggggccccgugc

SEQ ID NO: 41103 - RNA, 22 nt, Homo sapiens
ugccauguccccucucauccua

SEQ ID NO: 41104 - RNA, 23 nt, Homo sapiens
agcuaaggucagcuguuaccuca

SEQ ID NO: 41105 - RNA, 16 nt, Homo sapiens
cuuucucucugucuca

SEQ ID NO: 41106 - RNA, 23 nt, Homo sapiens
gacucugggcaccccucucacca

SEQ ID NO: 41107 - RNA, 20 nt, Homo sapiens
gccaccuucaagagcccaga

SEQ ID NO: 41108 - RNA, 19 nt, Homo sapiens
gucucuugguuuugacaga

SEQ ID NO: 41109 - RNA, 19 nt, Homo sapiens
cugcaagcuccgccuccca

SEQ ID NO: 41110 - RNA, 22 nt, Homo sapiens
uuguguaguaaaccuuacuuug

SEQ ID NO: 41111 - RNA, 18 nt, Homo sapiens
aguagucaaggugucaga

SEQ ID NO: 41112 - RNA, 17 nt, Homo sapiens
acugcugucucacccuc

SEQ ID NO: 41113 - RNA, 20 nt, Homo sapiens
caucuggccccaccugcuca

SEQ ID NO: 41114 - RNA, 16 nt, Homo sapiens
cccgacuuggagggca

SEQ ID NO: 41115 - RNA, 17 nt, Homo sapiens
gcucccagaacaggcac

SEQ ID NO: 41116 - RNA, 18 nt, Homo sapiens
guggccuccaauacccca

SEQ ID NO: 41117 - RNA, 20 nt, Homo sapiens
ucuggucagggccaggacac

SEQ ID NO: 41118 - RNA, 22 nt, Homo sapiens
ugcaccuaugcaacuuaacgug

SEQ ID NO: 41119 - RNA, 19 nt, Homo sapiens
ccagacccuguggucccuc

SEQ ID NO: 41120 - RNA, 23 nt, Homo sapiens
ugcucccagaaucuggugcucug

SEQ ID NO: 41121 - RNA, 18 nt, Homo sapiens
gaaggaagaauucccccc

SEQ ID NO: 41122 - RNA, 18 nt, Homo sapiens
acuagcugcuucuaguca

SEQ ID NO: 41123 - RNA, 18 nt, Homo sapiens
ggcuccauaccaauccca

SEQ ID NO: 41124 - RNA, 21 nt, Homo sapiens
aucuuggugacaaagagcccu

SEQ ID NO: 41125 - RNA, 17 nt, Homo sapiens
ccuaaaauuuccaacaa

SEQ ID NO: 41126 - RNA, 17 nt, Homo sapiens
ucaagugauucuccugc

SEQ ID NO: 41127 - RNA, 18 nt, Homo sapiens
uucuccugccucagccuu

SEQ ID NO: 41128 - RNA, 23 nt, Homo sapiens
ccugggccaguugauuugaccuu

SEQ ID NO: 41129 - RNA, 19 nt, Homo sapiens
aggaccguugguuccaguu

SEQ ID NO: 41130 - RNA, 21 nt, Homo sapiens
ggguccuuggcgccguccaca

SEQ ID NO: 41131 - RNA, 17 nt, Homo sapiens
ggugagcauggccagac

SEQ ID NO: 41132 - RNA, 18 nt, Homo sapiens
ucucuccacggcuuccgg

SEQ ID NO: 41133 - RNA, 20 nt, Homo sapiens
accgcguggccacuuggcuu

SEQ ID NO: 41134 - RNA, 21 nt, Homo sapiens
ccacaaaaagucauuccccca

SEQ ID NO: 41135 - RNA, 17 nt, Homo sapiens
ccuguccccugcccacu

SEQ ID NO: 41136 - RNA, 19 nt, Homo sapiens
ccuuggauaaaagauuugc

SEQ ID NO: 41137 - RNA, 17 nt, Homo sapiens
ggacuccaacgugggcu

SEQ ID NO: 41138 - RNA, 21 nt, Homo sapiens
ucuggcugaauauccacugga

SEQ ID NO: 41139 - RNA, 24 nt, Homo sapiens
accgcucaacuacauggaaaccga

SEQ ID NO: 41140 - RNA, 22 nt, Homo sapiens
accuuugcuagcugccuggucc

SEQ ID NO: 41141 - RNA, 22 nt, Homo sapiens
cagcaguguggcucaggugcca

SEQ ID NO: 41142 - RNA, 19 nt, Homo sapiens
cccccaaccuuccaccuca

SEQ ID NO: 41143 - RNA, 19 nt, Homo sapiens
cugcucccuucaccuuuga

SEQ ID NO: 41144 - RNA, 24 nt, Homo sapiens
gaggccuagacggcacaugccaua

SEQ ID NO: 41145 - RNA, 18 nt, Homo sapiens
uccagaaaaugaaauucc

SEQ ID NO: 41146 - RNA, 20 nt, Homo sapiens
ugcucccagagccugagcau

SEQ ID NO: 41147 - RNA, 25 nt, Homo sapiens
cugcuauuagguauugcucucuucc

SEQ ID NO: 41148 - RNA, 24 nt, Homo sapiens
gccugagcccaccgugccuggccu

SEQ ID NO: 41149 - RNA, 22 nt, Homo sapiens
aggcugggagggacauacuuuc

SEQ ID NO: 41150 - RNA, 23 nt, Homo sapiens
accuagccuagaggcggcugcca

SEQ ID NO: 41151 - RNA, 17 nt, Homo sapiens
agagaggcuggcaucuu

SEQ ID NO: 41152 - RNA, 23 nt, Homo sapiens
gcagcacccagagcuuauuguua

SEQ ID NO: 41153 - RNA, 23 nt, Homo sapiens
accuagccuagaggcggcugcca

SEQ ID NO: 41154 - RNA, 23 nt, Homo sapiens
accuagccuagaggcggcugcca

SEQ ID NO: 41155 - RNA, 19 nt, Homo sapiens
acggugaccgccuccugcu

SEQ ID NO: 41156 - RNA, 18 nt, Homo sapiens
acugcuacuugcucugcu

SEQ ID NO: 41157 - RNA, 20 nt, Homo sapiens
ucaggcagauaacugcugua

SEQ ID NO: 41158 - RNA, 22 nt, Homo sapiens
cagaaaccagcccccucgguga

SEQ ID NO: 41159 - RNA, 21 nt, Homo sapiens
acaucaggaagggcaauuccc

SEQ ID NO: 41160 - RNA, 21 nt, Homo sapiens
augcccagcaugcagaccagg

SEQ ID NO: 41161 - RNA, 17 nt, Homo sapiens
cugaagcaccuuuguga

SEQ ID NO: 41162 - RNA, 22 nt, Homo sapiens
gagccaagaccacaccacugca

SEQ ID NO: 41163 - RNA, 21 nt, Homo sapiens
gugucuccccugagcccggug

SEQ ID NO: 41164 - RNA, 19 nt, Homo sapiens
uaguuacagcuacuuggca

SEQ ID NO: 41165 - RNA, 19 nt, Homo sapiens
ugcccaggccacucuccag

SEQ ID NO: 41166 - RNA, 18 nt, Homo sapiens
agaauucuggauuccuga

SEQ ID NO: 41167 - RNA, 17 nt, Homo sapiens
cagguggcaccuucuca

SEQ ID NO: 41168 - RNA, 24 nt, Homo sapiens
ccuuggacagggcuccuuggccuu

SEQ ID NO: 41169 - RNA, 16 nt, Homo sapiens
gaauuuccucuggugc

SEQ ID NO: 41170 - RNA, 19 nt, Homo sapiens
gacaccauucaguucuuaa

SEQ ID NO: 41171 - RNA, 18 nt, Homo sapiens
gagauugugugccuagca

SEQ ID NO: 41172 - RNA, 16 nt, Homo sapiens
gccuguccccauuuug

SEQ ID NO: 41173 - RNA, 21 nt, Homo sapiens
uaggaaaugucauugcuccuu

SEQ ID NO: 41174 - RNA, 20 nt, Homo sapiens
uccagaggagacagucccag

SEQ ID NO: 41175 - RNA, 22 nt, Homo sapiens
ucccgggugcugacagcaagcu

SEQ ID NO: 41176 - RNA, 19 nt, Homo sapiens
uggccuggacuucucuuug

SEQ ID NO: 41177 - RNA, 22 nt, Homo sapiens
uuuuuuuggcucucuggacuuu

SEQ ID NO: 41178 - RNA, 25 nt, Homo sapiens
augaaugcacggccgucgcuccguc

SEQ ID NO: 41179 - RNA, 20 nt, Homo sapiens
gaccucccccguggcuccuu

SEQ ID NO: 41180 - RNA, 23 nt, Homo sapiens
aucuuugucaaucuccccacuuu

SEQ ID NO: 41181 - RNA, 20 nt, Homo sapiens
ccaauaaucuuauccacucc

SEQ ID NO: 41182 - RNA, 17 nt, Homo sapiens
cggcacuccagccuggc

SEQ ID NO: 41183 - RNA, 22 nt, Homo sapiens
ugaaugcacuuugaugugagac

SEQ ID NO: 41184 - RNA, 24 nt, Homo sapiens
aaacaccccuaggcuguggaagca

SEQ ID NO: 41185 - RNA, 20 nt, Homo sapiens
aaagcccccgagaccuccca

SEQ ID NO: 41186 - RNA, 22 nt, Homo sapiens
acuuugugaugggcuucucuca

SEQ ID NO: 41187 - RNA, 20 nt, Homo sapiens
cagaagccaguugucagcua

SEQ ID NO: 41188 - RNA, 17 nt, Homo sapiens
ccuccaggguugcacca

SEQ ID NO: 41189 - RNA, 21 nt, Homo sapiens
gcagguggcccacacaugugc

SEQ ID NO: 41190 - RNA, 23 nt, Homo sapiens
gguuguguaaaagccuguggcac

SEQ ID NO: 41191 - RNA, 20 nt, Homo sapiens
ucugagcaauccuuuugcuu

SEQ ID NO: 41192 - RNA, 19 nt, Homo sapiens
ucugcugacgaugaggcag

SEQ ID NO: 41193 - RNA, 16 nt, Homo sapiens
ugcauuacauauucca

SEQ ID NO: 41194 - RNA, 17 nt, Homo sapiens
uguaaaucaauguuuug

SEQ ID NO: 41195 - RNA, 20 nt, Homo sapiens
accauuauucucaucaccau

SEQ ID NO: 41196 - RNA, 21 nt, Homo sapiens
accugcgaaagaaagcccaca

SEQ ID NO: 41197 - RNA, 18 nt, Homo sapiens
caucaucaccaucaccau

SEQ ID NO: 41198 - RNA, 19 nt, Homo sapiens
cgcccgaguccacagacaa

SEQ ID NO: 41199 - RNA, 24 nt, Homo sapiens
ucaucaccaucaccgucaccguca

SEQ ID NO: 41200 - RNA, 22 nt, Homo sapiens
cacaugcgcgcacacacacagg

SEQ ID NO: 41201 - RNA, 20 nt, Homo sapiens
cucucagagccucugcuucu

SEQ ID NO: 41202 - RNA, 17 nt, Homo sapiens
guucccagggugagugg

SEQ ID NO: 41203 - RNA, 18 nt, Homo sapiens
uugccccccaccacccca

SEQ ID NO: 41204 - RNA, 21 nt, Homo sapiens
cuggguauggagggucuugag

SEQ ID NO: 41205 - RNA, 21 nt, Homo sapiens
gccugggucuaagccaggucu

SEQ ID NO: 41206 - RNA, 23 nt, Homo sapiens
aaaauauuuucaaagugaagcug

SEQ ID NO: 41207 - RNA, 18 nt, Homo sapiens
aggacuaccauugaccuc

SEQ ID NO: 41208 - RNA, 21 nt, Homo sapiens
gccauugauuuuggugaccca

SEQ ID NO: 41209 - RNA, 18 nt, Homo sapiens
gccuggagucucaggugg

SEQ ID NO: 41210 - RNA, 21 nt, Homo sapiens
ucgcugguccuuuuucuuucc

SEQ ID NO: 41211 - RNA, 19 nt, Homo sapiens
uuucgaugucaaucaucac

SEQ ID NO: 41212 - RNA, 23 nt, Homo sapiens
acuuggauuaaacaugucugccu

SEQ ID NO: 41213 - RNA, 20 nt, Homo sapiens
uagauugaacacauggaaug

SEQ ID NO: 41214 - RNA, 17 nt, Homo sapiens
aaacacagaaggcggug

SEQ ID NO: 41215 - RNA, 23 nt, Homo sapiens
auuugggcucugacaucuggccu

SEQ ID NO: 41216 - RNA, 19 nt, Homo sapiens
cacaauggcaagugucuua

SEQ ID NO: 41217 - RNA, 23 nt, Homo sapiens
caccaucguaccacugcacucca

SEQ ID NO: 41218 - RNA, 19 nt, Homo sapiens
cagaacuagaagcaaaacc

SEQ ID NO: 41219 - RNA, 19 nt, Homo sapiens
cccuaaaccucagacucuu

SEQ ID NO: 41220 - RNA, 24 nt, Homo sapiens
cguguucacuuugaaaacacguca

SEQ ID NO: 41221 - RNA, 21 nt, Homo sapiens
cucuuucucucucucucucuc

SEQ ID NO: 41222 - RNA, 21 nt, Homo sapiens
ggugcguuaagaaggcauguc

SEQ ID NO: 41223 - RNA, 21 nt, Homo sapiens
uaaaccucagacucuuccagc

SEQ ID NO: 41224 - RNA, 19 nt, Homo sapiens
uacaacucccaccccacca

SEQ ID NO: 41225 - RNA, 18 nt, Homo sapiens
ucauuguuguuuuaauuu

SEQ ID NO: 41226 - RNA, 17 nt, Homo sapiens
ucauuuccaccugcaaa

SEQ ID NO: 41227 - RNA, 23 nt, Homo sapiens
acacaggaccccucagcacacug

SEQ ID NO: 41228 - RNA, 17 nt, Homo sapiens
agcuuaauguaucugaa

SEQ ID NO: 41229 - RNA, 19 nt, Homo sapiens
caccaacgggugcaucaca

SEQ ID NO: 41230 - RNA, 18 nt, Homo sapiens
cgagcagggaaacugugu

SEQ ID NO: 41231 - RNA, 18 nt, Homo sapiens
gcuccccauggcacuguu

SEQ ID NO: 41232 - RNA, 17 nt, Homo sapiens
acaauucaagcuuucga

SEQ ID NO: 41233 - RNA, 19 nt, Homo sapiens
acuuucagagcaauuaucu

SEQ ID NO: 41234 - RNA, 17 nt, Homo sapiens
cucaggggacaauucaa

SEQ ID NO: 41235 - RNA, 19 nt, Homo sapiens
gucuaccagggccaacgua

SEQ ID NO: 41236 - RNA, 17 nt, Homo sapiens
aacuaaaacaacuccau

SEQ ID NO: 41237 - RNA, 23 nt, Homo sapiens
aaugcacaaugggaagaaucuua

SEQ ID NO: 41238 - RNA, 19 nt, Homo sapiens
caguccagccccuuacuca

SEQ ID NO: 41239 - RNA, 20 nt, Homo sapiens
ccuuaauagcauacccucca

SEQ ID NO: 41240 - RNA, 21 nt, Homo sapiens
gccucaguuucagauucuuuu

SEQ ID NO: 41241 - RNA, 23 nt, Homo sapiens
ggcgugagccaccgcgcccggcc

SEQ ID NO: 41242 - RNA, 20 nt, Homo sapiens
ucagugcugcagcaaauggc

SEQ ID NO: 41243 - RNA, 21 nt, Homo sapiens
ucuguauugagaaguuauucu

SEQ ID NO: 41244 - RNA, 20 nt, Homo sapiens
uucaagaccagccugaccaa

SEQ ID NO: 41245 - RNA, 15 nt, Homo sapiens
aauuuccuuucccca

SEQ ID NO: 41246 - RNA, 18 nt, Homo sapiens
cauggucacaggaugcac

SEQ ID NO: 41247 - RNA, 18 nt, Homo sapiens
ucccuaugugagguuugu

SEQ ID NO: 41248 - RNA, 27 nt, Homo sapiens
ucuguggcaaaauuucagacuauuuuu

SEQ ID NO: 41249 - RNA, 22 nt, Homo sapiens
uuuuggggguggggguugcgga

SEQ ID NO: 41250 - RNA, 19 nt, Homo sapiens
acaaagcauaaacaauuua

SEQ ID NO: 41251 - RNA, 19 nt, Homo sapiens
agaaauaauuauuugguua

SEQ ID NO: 41252 - RNA, 17 nt, Homo sapiens
agggauugaccagagua

SEQ ID NO: 41253 - RNA, 22 nt, Homo sapiens
auaaugaauaauuuuggcugag

SEQ ID NO: 41254 - RNA, 23 nt, Homo sapiens
gccagucacuuuucccucuuaga

SEQ ID NO: 41255 - RNA, 18 nt, Homo sapiens
uaaugcuucaguagaaua

SEQ ID NO: 41256 - RNA, 16 nt, Homo sapiens
uaguucuacugcuuga

SEQ ID NO: 41257 - RNA, 22 nt, Homo sapiens
uaguucuacugcuugauuacuu

SEQ ID NO: 41258 - RNA, 18 nt, Homo sapiens
ucaccauauguuauuugc

SEQ ID NO: 41259 - RNA, 19 nt, Homo sapiens
ugguuuucagaugaaauug

SEQ ID NO: 41260 - RNA, 22 nt, Homo sapiens
uguuuuuucuucugcccaggca

SEQ ID NO: 41261 - RNA, 20 nt, Homo sapiens
uuccucauuuauaacaggga

SEQ ID NO: 41262 - RNA, 21 nt, Homo sapiens
uuggaccucacaaaucuugua

SEQ ID NO: 41263 - RNA, 21 nt, Homo sapiens
uuucuuuccugucuuaaacuu

SEQ ID NO: 41264 - RNA, 19 nt, Homo sapiens
cugcuaauggggauggggu

SEQ ID NO: 41265 - RNA, 19 nt, Homo sapiens
ggcauugccaggccucuca

SEQ ID NO: 41266 - RNA, 22 nt, Homo sapiens
uaaacaaaaauguaccuucaca

SEQ ID NO: 41267 - RNA, 18 nt, Homo sapiens
uuuacaaaaaccagcuca

SEQ ID NO: 41268 - RNA, 21 nt, Homo sapiens
ugaaugugaccgcugugguuu

SEQ ID NO: 41269 - RNA, 19 nt, Homo sapiens
aaaguuguuuuucuggcag

SEQ ID NO: 41270 - RNA, 20 nt, Homo sapiens
aggaggugagggcaauacuc

SEQ ID NO: 41271 - RNA, 17 nt, Homo sapiens
cuuguggccaugccgaa

SEQ ID NO: 41272 - RNA, 19 nt, Homo sapiens
uaagugggucuuuuaaacu

SEQ ID NO: 41273 - RNA, 18 nt, Homo sapiens
ugguugauuuuuguuguu

SEQ ID NO: 41274 - RNA, 18 nt, Homo sapiens
uuaaagagaauuaccuca

SEQ ID NO: 41275 - RNA, 19 nt, Homo sapiens
agucaccucaccaagcauc

SEQ ID NO: 41276 - RNA, 17 nt, Homo sapiens
augaaaccuaucugaug

SEQ ID NO: 41277 - RNA, 18 nt, Homo sapiens
caugggcuauucauccuc

SEQ ID NO: 41278 - RNA, 23 nt, Homo sapiens
cccagaagcagguccuccaguga

SEQ ID NO: 41279 - RNA, 18 nt, Homo sapiens
cccuccccaaccaccuca

SEQ ID NO: 41280 - RNA, 20 nt, Homo sapiens
gagccuuuuucccacgcuuc

SEQ ID NO: 41281 - RNA, 19 nt, Homo sapiens
guguuuggaggguguugug

SEQ ID NO: 41282 - RNA, 17 nt, Homo sapiens
uggguuuggaaaaagga

SEQ ID NO: 41283 - RNA, 18 nt, Homo sapiens
uugaguagucugcauuuu

SEQ ID NO: 41284 - RNA, 21 nt, Homo sapiens
uuguauuaccauggguuugga

SEQ ID NO: 41285 - RNA, 18 nt, Homo sapiens
agguaaaagacuggaacg

SEQ ID NO: 41286 - RNA, 23 nt, Homo sapiens
ccgaagccauuaguuuaauagca

SEQ ID NO: 41287 - RNA, 19 nt, Homo sapiens
uagagagaccccaucucug

SEQ ID NO: 41288 - RNA, 22 nt, Homo sapiens
uggguggagagauguguaacug

SEQ ID NO: 41289 - RNA, 21 nt, Homo sapiens
aggagggcgagccgauugcca

SEQ ID NO: 41290 - RNA, 18 nt, Homo sapiens
auaccaaggucaucacug

SEQ ID NO: 41291 - RNA, 20 nt, Homo sapiens
ccgcacgcauagcugcccca

SEQ ID NO: 41292 - RNA, 20 nt, Homo sapiens
accuccacuuccucauuuca

SEQ ID NO: 41293 - RNA, 20 nt, Homo sapiens
ccucugccuccuggguucaa

SEQ ID NO: 41294 - RNA, 21 nt, Homo sapiens
gaauuuuuaaugugaacugga

SEQ ID NO: 41295 - RNA, 17 nt, Homo sapiens
ucaagugauucuccugc

SEQ ID NO: 41296 - RNA, 18 nt, Homo sapiens
caacccucaucucccucc

SEQ ID NO: 41297 - RNA, 22 nt, Homo sapiens
cuccaaguuuugaagguauaau

SEQ ID NO: 41298 - RNA, 21 nt, Homo sapiens
aaaucuuccucaaccaaauaa

SEQ ID NO: 41299 - RNA, 16 nt, Homo sapiens
accccgagaucagugc

SEQ ID NO: 41300 - RNA, 18 nt, Homo sapiens
cagagacggaugguguuu

SEQ ID NO: 41301 - RNA, 19 nt, Homo sapiens
ccaguggccaaagcugaca

SEQ ID NO: 41302 - RNA, 20 nt, Homo sapiens
cgagaaucucauuuaacagg

SEQ ID NO: 41303 - RNA, 20 nt, Homo sapiens
uggccucugaugugaaagug

SEQ ID NO: 41304 - RNA, 18 nt, Homo sapiens
gcccaagugcccuccucu

SEQ ID NO: 41305 - RNA, 20 nt, Homo sapiens
ccuccuguccucagggauca

SEQ ID NO: 41306 - RNA, 18 nt, Homo sapiens
cuacaggcugggguggcc

SEQ ID NO: 41307 - RNA, 22 nt, Homo sapiens
gaaaaccaaccccacccugcca

SEQ ID NO: 41308 - RNA, 19 nt, Homo sapiens
gggacugcugguugccaac

SEQ ID NO: 41309 - RNA, 17 nt, Homo sapiens
uagcacagugcuuggca

SEQ ID NO: 41310 - RNA, 17 nt, Homo sapiens
cgcagccccaccgcccu

SEQ ID NO: 41311 - RNA, 21 nt, Homo sapiens
gcgcagagcagggcuggcagg

SEQ ID NO: 41312 - RNA, 23 nt, Homo sapiens
gcuucucugcuggccccgcgccu

SEQ ID NO: 41313 - RNA, 22 nt, Homo sapiens
cagggccuggcuggguccagcg

SEQ ID NO: 41314 - RNA, 21 nt, Homo sapiens
ccugcugaggaagaguuaacc

SEQ ID NO: 41315 - RNA, 19 nt, Homo sapiens
ccuggaggccaucaugggc

SEQ ID NO: 41316 - RNA, 17 nt, Homo sapiens
cuaaccguguucuaccu

SEQ ID NO: 41317 - RNA, 22 nt, Homo sapiens
gaggccaucaugggccuggaga

SEQ ID NO: 41318 - RNA, 25 nt, Homo sapiens
ucugugaaaucuguaacaauggaga

SEQ ID NO: 41319 - RNA, 20 nt, Homo sapiens
aauucacacaaacuuacaug

SEQ ID NO: 41320 - RNA, 18 nt, Homo sapiens
auuuuucuugcuauuuuu

SEQ ID NO: 41321 - RNA, 18 nt, Homo sapiens
ccugcaaccuccaccucc

SEQ ID NO: 41322 - RNA, 24 nt, Homo sapiens
ugaauucucuuuagcauaaagcug

SEQ ID NO: 41323 - RNA, 19 nt, Homo sapiens
uguaaaauaccucuggaua

SEQ ID NO: 41324 - RNA, 19 nt, Homo sapiens
uguaaaauaccucuggaua

SEQ ID NO: 41325 - RNA, 23 nt, Homo sapiens
uguguccuuaaacuauuucugaa

SEQ ID NO: 41326 - RNA, 23 nt, Homo sapiens
uucuaagcugucuuaauugucua

SEQ ID NO: 41327 - RNA, 24 nt, Homo sapiens
uucucauuguguaggauuugugaa

SEQ ID NO: 41328 - RNA, 18 nt, Homo sapiens
uuugcccgccucugccuc

SEQ ID NO: 41329 - RNA, 22 nt, Homo sapiens
ccucuuuuuuguuuucaacuuu

SEQ ID NO: 41330 - RNA, 21 nt, Homo sapiens
gccacgcaccgguuagugaga

SEQ ID NO: 41331 - RNA, 22 nt, Homo sapiens
gccuuuggccgacugucugcuc

SEQ ID NO: 41332 - RNA, 21 nt, Homo sapiens
uagcuuuggcacaaagcagca

SEQ ID NO: 41333 - RNA, 16 nt, Homo sapiens
ucaauacaugccccaa

SEQ ID NO: 41334 - RNA, 16 nt, Homo sapiens
uucauaccauaacucu

SEQ ID NO: 41335 - RNA, 19 nt, Homo sapiens
caagcuucugauccuccca

SEQ ID NO: 41336 - RNA, 21 nt, Homo sapiens
ccuguucaucuuucagggcuu

SEQ ID NO: 41337 - RNA, 23 nt, Homo sapiens
acacagguagcaucccucuaguc

SEQ ID NO: 41338 - RNA, 21 nt, Homo sapiens
acuucuucaugacaccaaauc

SEQ ID NO: 41339 - RNA, 18 nt, Homo sapiens
guaguuucaaacucuuug

SEQ ID NO: 41340 - RNA, 23 nt, Homo sapiens
uagaugggcuuuaguaaagacug

SEQ ID NO: 41341 - RNA, 19 nt, Homo sapiens
cggcccucccacgguggac

SEQ ID NO: 41342 - RNA, 20 nt, Homo sapiens
cugggagcagagaggcugga

SEQ ID NO: 41343 - RNA, 17 nt, Homo sapiens
cuugcuccaggucacuu

SEQ ID NO: 41344 - RNA, 25 nt, Homo sapiens
uccaaaaauuguacagaugauucaa

SEQ ID NO: 41345 - RNA, 18 nt, Homo sapiens
ucugcugggcucugccuc

SEQ ID NO: 41346 - RNA, 18 nt, Homo sapiens
caacaggaggccggggaa

SEQ ID NO: 41347 - RNA, 17 nt, Homo sapiens
ccugcaggccaauucaa

SEQ ID NO: 41348 - RNA, 17 nt, Homo sapiens
gaaggcagggucugcuu

SEQ ID NO: 41349 - RNA, 21 nt, Homo sapiens
gccugcccugauugccugccc

SEQ ID NO: 41350 - RNA, 18 nt, Homo sapiens
ucagcaggaggaguuugg

SEQ ID NO: 41351 - RNA, 22 nt, Homo sapiens
auuagugauguguacaccugca

SEQ ID NO: 41352 - RNA, 20 nt, Homo sapiens
ugaauggcaggauaugaagc

SEQ ID NO: 41353 - RNA, 19 nt, Homo sapiens
aggccacacugcccuccca

SEQ ID NO: 41354 - RNA, 20 nt, Homo sapiens
ccucugccuccuggguucaa

SEQ ID NO: 41355 - RNA, 18 nt, Homo sapiens
ccugcaaccuccaccucc

SEQ ID NO: 41356 - RNA, 19 nt, Homo sapiens
cugcaaccuccaccuccca

SEQ ID NO: 41357 - RNA, 17 nt, Homo sapiens
cugccucaugacuccca

SEQ ID NO: 41358 - RNA, 22 nt, Homo sapiens
ggugaaugugugggugugugug

SEQ ID NO: 41359 - RNA, 21 nt, Homo sapiens
gugugugugaguggguaugau

SEQ ID NO: 41360 - RNA, 18 nt, Homo sapiens
uccaccucccagguucaa

SEQ ID NO: 41361 - RNA, 17 nt, Homo sapiens
uucuccugccuuagccu

SEQ ID NO: 41362 - RNA, 19 nt, Homo sapiens
gucacccucaccugucgca

SEQ ID NO: 41363 - RNA, 19 nt, Homo sapiens
guuggugagcuguucuucc

SEQ ID NO: 41364 - RNA, 20 nt, Homo sapiens
ucaccugccaggugaggaca

SEQ ID NO: 41365 - RNA, 19 nt, Homo sapiens
aaggacugccccaccuuua

SEQ ID NO: 41366 - RNA, 20 nt, Homo sapiens
cacacuuccacuccaccuca

SEQ ID NO: 41367 - RNA, 24 nt, Homo sapiens
ccccacacuuccacuccaccucac

SEQ ID NO: 41368 - RNA, 26 nt, Homo sapiens
ccuaaacucuucucucccccagcaaa

SEQ ID NO: 41369 - RNA, 19 nt, Homo sapiens
cuuuuccuaguauugugag

SEQ ID NO: 41370 - RNA, 21 nt, Homo sapiens
gcccaacaucccuuuaccucu

SEQ ID NO: 41371 - RNA, 20 nt, Homo sapiens
cagggggcuugggucucguu

SEQ ID NO: 41372 - RNA, 17 nt, Homo sapiens
cuguaucagugcaggga

SEQ ID NO: 41373 - RNA, 23 nt, Homo sapiens
cuugccuuugaugauuauucuua

SEQ ID NO: 41374 - RNA, 15 nt, Homo sapiens
agucuuuuucccaca

SEQ ID NO: 41375 - RNA, 18 nt, Homo sapiens
ccagagagaacaauguau

SEQ ID NO: 41376 - RNA, 20 nt, Homo sapiens
ccauacagcaaaggagaagc

SEQ ID NO: 41377 - RNA, 20 nt, Homo sapiens
uaugugcuacccuuccuuca

SEQ ID NO: 41378 - RNA, 21 nt, Homo sapiens
cacuccccgcagucccccuga

SEQ ID NO: 41379 - RNA, 20 nt, Homo sapiens
ucaaggacuacucauuucca

SEQ ID NO: 41380 - RNA, 19 nt, Homo sapiens
aaacacauaucaagaucca

SEQ ID NO: 41381 - RNA, 17 nt, Homo sapiens
gcaaccucagccaauga

SEQ ID NO: 41382 - RNA, 20 nt, Homo sapiens
cucccucucgcuucugccuc

SEQ ID NO: 41383 - RNA, 20 nt, Homo sapiens
uuugggaccccgugccuccu

SEQ ID NO: 41384 - RNA, 19 nt, Homo sapiens
cagagccucaccugccuca

SEQ ID NO: 41385 - RNA, 16 nt, Homo sapiens
ccaugcucagguuuaa

SEQ ID NO: 41386 - RNA, 16 nt, Homo sapiens
ggcaagaaucugcaau

SEQ ID NO: 41387 - RNA, 21 nt, Homo sapiens
uuucuucugucccuugaccuu

SEQ ID NO: 41388 - RNA, 19 nt, Homo sapiens
acccuuucugcagaaagua

SEQ ID NO: 41389 - RNA, 18 nt, Homo sapiens
ugagcacaucacacauca

SEQ ID NO: 41390 - RNA, 19 nt, Homo sapiens
ucaggccuggacagccuca

SEQ ID NO: 41391 - RNA, 16 nt, Homo sapiens
ucccacugcgccccug

SEQ ID NO: 41392 - RNA, 18 nt, Homo sapiens
auuuuuuuccccauucau

SEQ ID NO: 41393 - RNA, 18 nt, Homo sapiens
ccaaagcucgccaucuug

SEQ ID NO: 41394 - RNA, 20 nt, Homo sapiens
ccaaaugaucuucccacccc

SEQ ID NO: 41395 - RNA, 17 nt, Homo sapiens
cugacccaggguuuuga

SEQ ID NO: 41396 - RNA, 19 nt, Homo sapiens
cuugacacacuguuacugu

SEQ ID NO: 41397 - RNA, 19 nt, Homo sapiens
ucuugaugguaucauuugc

SEQ ID NO: 41398 - RNA, 17 nt, Homo sapiens
ugucugccuuggguucc

SEQ ID NO: 41399 - RNA, 19 nt, Homo sapiens
uuguggaaaaaugucuguu

SEQ ID NO: 41400 - RNA, 19 nt, Homo sapiens
aacugaugucaaaaccaga

SEQ ID NO: 41401 - RNA, 23 nt, Homo sapiens
acaccagccccaaaggcaauucu

SEQ ID NO: 41402 - RNA, 18 nt, Homo sapiens
accagaaagacauugggc

SEQ ID NO: 41403 - RNA, 21 nt, Homo sapiens
accagagaguucacacuaggg

SEQ ID NO: 41404 - RNA, 19 nt, Homo sapiens
aucuccaagguagaccuca

SEQ ID NO: 41405 - RNA, 23 nt, Homo sapiens
uccuggccccaaggggccugugg

SEQ ID NO: 41406 - RNA, 19 nt, Homo sapiens
uucacugaccccaucucca

SEQ ID NO: 41407 - RNA, 19 nt, Homo sapiens
gagacaccuggguucaguc

SEQ ID NO: 41408 - RNA, 19 nt, Homo sapiens
gcccuggccuagagaccag

SEQ ID NO: 41409 - RNA, 18 nt, Homo sapiens
ucugaccgacuaacaucu

SEQ ID NO: 41410 - RNA, 18 nt, Homo sapiens
ugggcugauuuggaacug

SEQ ID NO: 41411 - RNA, 21 nt, Homo sapiens
aggucuccacgucugcccagg

SEQ ID NO: 41412 - RNA, 27 nt, Homo sapiens
cauggacacaauuuccacaaccuuuca

SEQ ID NO: 41413 - RNA, 22 nt, Homo sapiens
cccagacccagagcgucacaaa

SEQ ID NO: 41414 - RNA, 18 nt, Homo sapiens
gcaggcgacacgggggua

SEQ ID NO: 41415 - RNA, 19 nt, Homo sapiens
gugaucuggaaaucuacca

SEQ ID NO: 41416 - RNA, 18 nt, Homo sapiens
uggccaggucagaagcau

SEQ ID NO: 41417 - RNA, 17 nt, Homo sapiens
ugugaucuggaaaucua

SEQ ID NO: 41418 - RNA, 23 nt, Homo sapiens
uugccucuuccuuucucccauca

SEQ ID NO: 41419 - RNA, 18 nt, Homo sapiens
acaguguaacacuucuca

SEQ ID NO: 41420 - RNA, 18 nt, Homo sapiens
cccuccaaccucccccaa

SEQ ID NO: 41421 - RNA, 21 nt, Homo sapiens
gauugaugaguguucuuuuaa

SEQ ID NO: 41422 - RNA, 22 nt, Homo sapiens
uauuucauacuccccgcuucca

SEQ ID NO: 41423 - RNA, 20 nt, Homo sapiens
ugcacucugauaucagacug

SEQ ID NO: 41424 - RNA, 18 nt, Homo sapiens
uggugagagcuugugaac

SEQ ID NO: 41425 - RNA, 18 nt, Homo sapiens
cauggcgcagcguacgua

SEQ ID NO: 41426 - RNA, 17 nt, Homo sapiens
cugucucccaucacccc

SEQ ID NO: 41427 - RNA, 18 nt, Homo sapiens
uacccugacucucaccug

SEQ ID NO: 41428 - RNA, 19 nt, Homo sapiens
uaguggaagacacagauuc

SEQ ID NO: 41429 - RNA, 22 nt, Homo sapiens
cuucagucugccuggcgucaca

SEQ ID NO: 41430 - RNA, 17 nt, Homo sapiens
ucacugccagaauucaa

SEQ ID NO: 41431 - RNA, 24 nt, Homo sapiens
auucuuaaugaggugauauaauca

SEQ ID NO: 41432 - RNA, 23 nt, Homo sapiens
ccagaugccaacagccaccauuc

SEQ ID NO: 41433 - RNA, 18 nt, Homo sapiens
ucuuuagggucuacccca

SEQ ID NO: 41434 - RNA, 19 nt, Homo sapiens
ugucaucuagguuaaucca

SEQ ID NO: 41435 - RNA, 18 nt, Homo sapiens
uuguguauauauaccaca

SEQ ID NO: 41436 - RNA, 20 nt, Homo sapiens
aauguggccuggccaagcug

SEQ ID NO: 41437 - RNA, 23 nt, Homo sapiens
acuccagaucucagacuuucuca

SEQ ID NO: 41438 - RNA, 19 nt, Homo sapiens
augcugggaccuacgguga

SEQ ID NO: 41439 - RNA, 18 nt, Homo sapiens
cuggccaagcugacgucc

SEQ ID NO: 41440 - RNA, 23 nt, Homo sapiens
aguuucacuuuguauaaaaguua

SEQ ID NO: 41441 - RNA, 23 nt, Homo sapiens
ccuucccccauuaacuucccccc

SEQ ID NO: 41442 - RNA, 17 nt, Homo sapiens
cucaacaaagggcuuuu

SEQ ID NO: 41443 - RNA, 19 nt, Homo sapiens
cucuauauaguuucacuuu

SEQ ID NO: 41444 - RNA, 15 nt, Homo sapiens
cuucuucccauuuug

SEQ ID NO: 41445 - RNA, 23 nt, Homo sapiens
cuugcuccuuuugaguugcuuuu

SEQ ID NO: 41446 - RNA, 19 nt, Homo sapiens
ugacugccuggcacauagu

SEQ ID NO: 41447 - RNA, 21 nt, Homo sapiens
uuugagauguugaguuacuuu

SEQ ID NO: 41448 - RNA, 19 nt, Homo sapiens
caaaauuuagaauuuggcc

SEQ ID NO: 41449 - RNA, 21 nt, Homo sapiens
cagcauagcagccacaagcca

SEQ ID NO: 41450 - RNA, 24 nt, Homo sapiens
ccacagguuucucucuccaucccu

SEQ ID NO: 41451 - RNA, 20 nt, Homo sapiens
gauauuccgguaaucuuuua

SEQ ID NO: 41452 - RNA, 20 nt, Homo sapiens
gacugcaccacugcauucca

SEQ ID NO: 41453 - RNA, 24 nt, Homo sapiens
ggcaaugacccaagaccaucaucu

SEQ ID NO: 41454 - RNA, 24 nt, Homo sapiens
ugaagucuuggguuggacauuuca

SEQ ID NO: 41455 - RNA, 17 nt, Homo sapiens
ugcaccacugcauucca

SEQ ID NO: 41456 - RNA, 22 nt, Homo sapiens
uggaaacagaugagagacaaca

SEQ ID NO: 41457 - RNA, 19 nt, Homo sapiens
cgucccaguccuucaacac

SEQ ID NO: 41458 - RNA, 17 nt, Homo sapiens
ggcaaaggcaaaauacc

SEQ ID NO: 41459 - RNA, 21 nt, Homo sapiens
ucuauuuucuucuucuguucc

SEQ ID NO: 41460 - RNA, 17 nt, Homo sapiens
aucuacuugcuacuucu

SEQ ID NO: 41461 - RNA, 18 nt, Homo sapiens
caaccccccauucccucc

SEQ ID NO: 41462 - RNA, 26 nt, Homo sapiens
guuugagcuuccccacugccugaccc

SEQ ID NO: 41463 - RNA, 19 nt, Homo sapiens
uuugguccuuuaaccgaca

SEQ ID NO: 41464 - RNA, 21 nt, Homo sapiens
aucugagcugcgggagggccc

SEQ ID NO: 41465 - RNA, 17 nt, Homo sapiens
cacugagccucauacca

SEQ ID NO: 41466 - RNA, 20 nt, Homo sapiens
ccaguuucauguucccugaa

SEQ ID NO: 41467 - RNA, 23 nt, Homo sapiens
gccagucaagaccuuucuccaga

SEQ ID NO: 41468 - RNA, 18 nt, Homo sapiens
uauaccagcacauuaaca

SEQ ID NO: 41469 - RNA, 20 nt, Homo sapiens
ugggucagacccgggucaca

SEQ ID NO: 41470 - RNA, 18 nt, Homo sapiens
aauggaugacuuagaagg

SEQ ID NO: 41471 - RNA, 21 nt, Homo sapiens
agcuguuuuccauaaaucuca

SEQ ID NO: 41472 - RNA, 19 nt, Homo sapiens
aguagcaucccugcuccca

SEQ ID NO: 41473 - RNA, 18 nt, Homo sapiens
caauccuucuuuguuccu

SEQ ID NO: 41474 - RNA, 19 nt, Homo sapiens
caucuuaaguagccgaaca

SEQ ID NO: 41475 - RNA, 20 nt, Homo sapiens
cuggggacaaaaucacuccu

SEQ ID NO: 41476 - RNA, 21 nt, Homo sapiens
cuguacucacuagaugccagu

SEQ ID NO: 41477 - RNA, 18 nt, Homo sapiens
ucaugagaacagcaccaa

SEQ ID NO: 41478 - RNA, 19 nt, Homo sapiens
uccccgcucccaguuguga

SEQ ID NO: 41479 - RNA, 19 nt, Homo sapiens
ucccugcucccaguuguga

SEQ ID NO: 41480 - RNA, 20 nt, Homo sapiens
ucuaagcggucucccugcuu

SEQ ID NO: 41481 - RNA, 21 nt, Homo sapiens
ugacucagagcuucucaccca

SEQ ID NO: 41482 - RNA, 23 nt, Homo sapiens
aggaugcacacauacucauucaa

SEQ ID NO: 41483 - RNA, 23 nt, Homo sapiens
uuagaaauugagaccuguacaua

SEQ ID NO: 41484 - RNA, 21 nt, Homo sapiens
acgaggauuacaucguccuca

SEQ ID NO: 41485 - RNA, 19 nt, Homo sapiens
cucugggaagguggccaga

SEQ ID NO: 41486 - RNA, 23 nt, Homo sapiens
ggaggaggaagccauggaugaca

SEQ ID NO: 41487 - RNA, 23 nt, Homo sapiens
ggaggaggaggcuguggaugaca

SEQ ID NO: 41488 - RNA, 19 nt, Homo sapiens
ugacaucuuuuuuccccuu

SEQ ID NO: 41489 - RNA, 17 nt, Homo sapiens
uuuugaauguguuuguu

SEQ ID NO: 41490 - RNA, 18 nt, Homo sapiens
aagaggugcagagcauug

SEQ ID NO: 41491 - RNA, 18 nt, Homo sapiens
aucugcuaccacaccucu

SEQ ID NO: 41492 - RNA, 21 nt, Homo sapiens
ccagagagccacaccacuaca

SEQ ID NO: 41493 - RNA, 22 nt, Homo sapiens
ccagagagccugaaguugcuca

SEQ ID NO: 41494 - RNA, 17 nt, Homo sapiens
gacguuaaguccagaga

SEQ ID NO: 41495 - RNA, 20 nt, Homo sapiens
augcagacccugauauucca

SEQ ID NO: 41496 - RNA, 18 nt, Homo sapiens
cauccuccuccuauggcc

SEQ ID NO: 41497 - RNA, 23 nt, Homo sapiens
cuccagguucugcaaaaguuuga

SEQ ID NO: 41498 - RNA, 21 nt, Homo sapiens
cuggccaaacccagucuucca

SEQ ID NO: 41499 - RNA, 22 nt, Homo sapiens
gagccaagaucgcgcuacugca

SEQ ID NO: 41500 - RNA, 18 nt, Homo sapiens
gcuucgacugucucgccc

SEQ ID NO: 41501 - RNA, 20 nt, Homo sapiens
ugggaauuggcaaugaugaa

SEQ ID NO: 41502 - RNA, 18 nt, Homo sapiens
uggcuuucuugucccuua

SEQ ID NO: 41503 - RNA, 27 nt, Homo sapiens
uuugggcgaaaaucuuggaucauuuuu

SEQ ID NO: 41504 - RNA, 24 nt, Homo sapiens
agaggaacaggucagggucagaca

SEQ ID NO: 41505 - RNA, 29 nt, Homo sapiens
guccugacaaggauugagaggauuugugg

SEQ ID NO: 41506 - RNA, 22 nt, Homo sapiens
ucugaacugccauacucugccc

SEQ ID NO: 41507 - RNA, 20 nt, Homo sapiens
uggcauacucuaacauacuc

SEQ ID NO: 41508 - RNA, 21 nt, Homo sapiens
aaauaucucauccuuaccauc

SEQ ID NO: 41509 - RNA, 20 nt, Homo sapiens
ccucugccuccuggguucaa

SEQ ID NO: 41510 - RNA, 22 nt, Homo sapiens
uaucuccaaaaaccaucuucau

SEQ ID NO: 41511 - RNA, 23 nt, Homo sapiens
ucugcuucaagaucuuugcaugg

SEQ ID NO: 41512 - RNA, 18 nt, Homo sapiens
uggggucaaaggaugcac

SEQ ID NO: 41513 - RNA, 23 nt, Homo sapiens
uggucuugaacucuugggcucaa

SEQ ID NO: 41514 - RNA, 17 nt, Homo sapiens
uucuccugccuuagccu

SEQ ID NO: 41515 - RNA, 19 nt, Homo sapiens
agaaauagacaacgaucug

SEQ ID NO: 41516 - RNA, 23 nt, Homo sapiens
agucucugcuggacaacgcuagc

SEQ ID NO: 41517 - RNA, 19 nt, Homo sapiens
ccuuuaaucgucuuugaua

SEQ ID NO: 41518 - RNA, 19 nt, Homo sapiens
cuaggaucacagccacagg

SEQ ID NO: 41519 - RNA, 18 nt, Homo sapiens
gcagcaaacuguacaaca

SEQ ID NO: 41520 - RNA, 21 nt, Homo sapiens
uuucccaacaauggucaugac

SEQ ID NO: 41521 - RNA, 18 nt, Homo sapiens
aucuuaaggaaaagagga

SEQ ID NO: 41522 - RNA, 18 nt, Homo sapiens
cuaccugccuccccauca

SEQ ID NO: 41523 - RNA, 18 nt, Homo sapiens
gugcaacgaggacuugga

SEQ ID NO: 41524 - RNA, 18 nt, Homo sapiens
uggucguugcuguuuuua

SEQ ID NO: 41525 - RNA, 24 nt, Homo sapiens
uucuuccugacguggcaguuuaug

SEQ ID NO: 41526 - RNA, 15 nt, Homo sapiens
aacacaaaugugaca

SEQ ID NO: 41527 - RNA, 20 nt, Homo sapiens
aacguguggucgggccgagc

SEQ ID NO: 41528 - RNA, 19 nt, Homo sapiens
aaggaccagaauccucaga

SEQ ID NO: 41529 - RNA, 18 nt, Homo sapiens
caguuuaggauuguuaua

SEQ ID NO: 41530 - RNA, 19 nt, Homo sapiens
cuguuucaggucugacuca

SEQ ID NO: 41531 - RNA, 15 nt, Homo sapiens
uguuuagccauucua

SEQ ID NO: 41532 - RNA, 22 nt, Homo sapiens
cccaggcagcugccacugccca

SEQ ID NO: 41533 - RNA, 21 nt, Homo sapiens
gauggcgagccggacauacca

SEQ ID NO: 41534 - RNA, 20 nt, Homo sapiens
guugccccugcgccaaggga

SEQ ID NO: 41535 - RNA, 22 nt, Homo sapiens
ugcguaugaguacuugugugug

SEQ ID NO: 41536 - RNA, 20 nt, Homo sapiens
aguguaacucaauuauguca

SEQ ID NO: 41537 - RNA, 21 nt, Homo sapiens
auuauuucacuuaccauggca

SEQ ID NO: 41538 - RNA, 17 nt, Homo sapiens
ccuucuauuaacuguau

SEQ ID NO: 41539 - RNA, 17 nt, Homo sapiens
uccccacuccacacuuu

SEQ ID NO: 41540 - RNA, 20 nt, Homo sapiens
uuguuucuucaugacauaca

SEQ ID NO: 41541 - RNA, 22 nt, Homo sapiens
uuucacuuacauuauuucacuu

SEQ ID NO: 41542 - RNA, 19 nt, Homo sapiens
aagcaauucuccugccuca

SEQ ID NO: 41543 - RNA, 20 nt, Homo sapiens
ccucugccucccggguucaa

SEQ ID NO: 41544 - RNA, 24 nt, Homo sapiens
cuucuaauggugacuuccaucuca

SEQ ID NO: 41545 - RNA, 17 nt, Homo sapiens
gaagacaccacauuuca

SEQ ID NO: 41546 - RNA, 18 nt, Homo sapiens
uucugaucaucacugcug

SEQ ID NO: 41547 - RNA, 21 nt, Homo sapiens
gcaccuuccgccagcgccccu

SEQ ID NO: 41548 - RNA, 20 nt, Homo sapiens
cuaucaauaaaacaguauua

SEQ ID NO: 41549 - RNA, 20 nt, Homo sapiens
gaauaagaugcaguucugaa

SEQ ID NO: 41550 - RNA, 23 nt, Homo sapiens
gauuuauuccagugaccuugcua

SEQ ID NO: 41551 - RNA, 22 nt, Homo sapiens
uaugucuaauguuagacauuuu

SEQ ID NO: 41552 - RNA, 19 nt, Homo sapiens
uugccaaaguaauuacacu

SEQ ID NO: 41553 - RNA, 19 nt, Homo sapiens
gacucaaggaaacggaauu

SEQ ID NO: 41554 - RNA, 18 nt, Homo sapiens
ggugguaaaugacacacu

SEQ ID NO: 41555 - RNA, 21 nt, Homo sapiens
ccuuuuugucugcucuuggcc

SEQ ID NO: 41556 - RNA, 19 nt, Homo sapiens
ggccgggugcgguggcuca

SEQ ID NO: 41557 - RNA, 19 nt, Homo sapiens
uaagugggccuccugaaac

SEQ ID NO: 41558 - RNA, 18 nt, Homo sapiens
uggauggaucaccugagg

SEQ ID NO: 41559 - RNA, 20 nt, Homo sapiens
aaagccagaggcuuuggcaa

SEQ ID NO: 41560 - RNA, 19 nt, Homo sapiens
cuguuuuguguuuaaccuc

SEQ ID NO: 41561 - RNA, 23 nt, Homo sapiens
aagcaaguuggugaccuuccucu

SEQ ID NO: 41562 - RNA, 20 nt, Homo sapiens
uggcuuuuccgauauggaac

SEQ ID NO: 41563 - RNA, 24 nt, Homo sapiens
uggguggguuuucucugcagacua

SEQ ID NO: 41564 - RNA, 19 nt, Homo sapiens
ugguuggggggcaucagca

SEQ ID NO: 41565 - RNA, 22 nt, Homo sapiens
uuuuuauauauucuuuaaccuu

SEQ ID NO: 41566 - RNA, 22 nt, Homo sapiens
auguucugcugugauaacugcc

SEQ ID NO: 41567 - RNA, 22 nt, Homo sapiens
acauuuuuaacacgcuuacuua

SEQ ID NO: 41568 - RNA, 23 nt, Homo sapiens
ucaaaaaacauuauuuuuccuuu

SEQ ID NO: 41569 - RNA, 20 nt, Homo sapiens
ucauauauagcaucucugcu

SEQ ID NO: 41570 - RNA, 18 nt, Homo sapiens
uccgccuccuggguucaa

SEQ ID NO: 41571 - RNA, 20 nt, Homo sapiens
uggccaggcuggucuugaac

SEQ ID NO: 41572 - RNA, 19 nt, Homo sapiens
uugauacauucucacaaac

SEQ ID NO: 41573 - RNA, 22 nt, Homo sapiens
auggucuggagugcucuguaga

SEQ ID NO: 41574 - RNA, 19 nt, Homo sapiens
uguacuauacagaaggaca

SEQ ID NO: 41575 - RNA, 22 nt, Homo sapiens
uuucuuuauuccauguucuaua

SEQ ID NO: 41576 - RNA, 15 nt, Homo sapiens
agggaaaaaaagcaa

SEQ ID NO: 41577 - RNA, 18 nt, Homo sapiens
ccuccucccagauaccuc

SEQ ID NO: 41578 - RNA, 17 nt, Homo sapiens
ugaaugagaccugagug

SEQ ID NO: 41579 - RNA, 24 nt, Homo sapiens
agaaagaugcucuuucuccaagac

SEQ ID NO: 41580 - RNA, 18 nt, Homo sapiens
augaaagaguaaccuguc

SEQ ID NO: 41581 - RNA, 20 nt, Homo sapiens
cagaauauauacuagaagcu

SEQ ID NO: 41582 - RNA, 25 nt, Homo sapiens
ucuaugauucaguuuauguaaaaua

SEQ ID NO: 41583 - RNA, 19 nt, Homo sapiens
ugugcuguggacacugacu

SEQ ID NO: 41584 - RNA, 23 nt, Homo sapiens
aaagcugccccacccacucuccc

SEQ ID NO: 41585 - RNA, 22 nt, Homo sapiens
aagaccagcucucuccaggaca

SEQ ID NO: 41586 - RNA, 21 nt, Homo sapiens
accccauuuaacaaugugaag

SEQ ID NO: 41587 - RNA, 22 nt, Homo sapiens
acuccccagcaucuagaucuaa

SEQ ID NO: 41588 - RNA, 19 nt, Homo sapiens
aguauccacuccauccuca

SEQ ID NO: 41589 - RNA, 26 nt, Homo sapiens
cccuucugcaagccuggagacuggac

SEQ ID NO: 41590 - RNA, 18 nt, Homo sapiens
cuccugcucuuacuguuu

SEQ ID NO: 41591 - RNA, 23 nt, Homo sapiens
guucgccugaugagggcucucga

SEQ ID NO: 41592 - RNA, 24 nt, Homo sapiens
uccacgagacucuuuucugucccu

SEQ ID NO: 41593 - RNA, 15 nt, Homo sapiens
ucuaagcauuuggcc

SEQ ID NO: 41594 - RNA, 20 nt, Homo sapiens
ugguuccuaccuucacaucu

SEQ ID NO: 41595 - RNA, 20 nt, Homo sapiens
ugugguggagcauccugcug

SEQ ID NO: 41596 - RNA, 22 nt, Homo sapiens
uuucuaugacuguguuagcuuu

SEQ ID NO: 41597 - RNA, 18 nt, Homo sapiens
ccaagcacguagcccuuu

SEQ ID NO: 41598 - RNA, 27 nt, Homo sapiens
ucucuuuaucucuuugucuugugucuu

SEQ ID NO: 41599 - RNA, 17 nt, Homo sapiens
ugcuccaccagcuucuu

SEQ ID NO: 41600 - RNA, 21 nt, Homo sapiens
ccaaaaucaagcgacauuuua

SEQ ID NO: 41601 - RNA, 19 nt, Homo sapiens
gaaaaauggugacuccaca

SEQ ID NO: 41602 - RNA, 20 nt, Homo sapiens
gacauuuuaaaaagaaaaca

SEQ ID NO: 41603 - RNA, 18 nt, Homo sapiens
acuuaauaaaugacgucc

SEQ ID NO: 41604 - RNA, 17 nt, Homo sapiens
cauaccccuucucccug

SEQ ID NO: 41605 - RNA, 21 nt, Homo sapiens
ggacaucaccggcugcacgca

SEQ ID NO: 41606 - RNA, 27 nt, Homo sapiens
aagagagauacucugcacagguuuugg

SEQ ID NO: 41607 - RNA, 18 nt, Homo sapiens
aagauauuuauuguacac

SEQ ID NO: 41608 - RNA, 19 nt, Homo sapiens
auuuggccaucucgcuccu

SEQ ID NO: 41609 - RNA, 18 nt, Homo sapiens
cacugcuaacuaugcagg

SEQ ID NO: 41610 - RNA, 20 nt, Homo sapiens
ccaaccaaaagaucaugcua

SEQ ID NO: 41611 - RNA, 23 nt, Homo sapiens
ccacugcuaacuaugcagggcca

SEQ ID NO: 41612 - RNA, 18 nt, Homo sapiens
uuuucugacagggcagca

SEQ ID NO: 41613 - RNA, 19 nt, Homo sapiens
cagcuauuaauucaucaua

SEQ ID NO: 41614 - RNA, 23 nt, Homo sapiens
uaaucuccaaaaucugaaaugcu

SEQ ID NO: 41615 - RNA, 18 nt, Homo sapiens
ugggggaaaauuugugga

SEQ ID NO: 41616 - RNA, 23 nt, Homo sapiens
uguuccuuucuuuguguccuuga

SEQ ID NO: 41617 - RNA, 18 nt, Homo sapiens
cugugcacacauacacac

SEQ ID NO: 41618 - RNA, 20 nt, Homo sapiens
guagggggcauuauuuauua

SEQ ID NO: 41619 - RNA, 17 nt, Homo sapiens
uuucucugucuuaccuu

SEQ ID NO: 41620 - RNA, 22 nt, Homo sapiens
aacuuuuuuugcgacuuguuuu

SEQ ID NO: 41621 - RNA, 18 nt, Homo sapiens
agcuucugacucuuucuu

SEQ ID NO: 41622 - RNA, 20 nt, Homo sapiens
auaguugugugccaagcacu

SEQ ID NO: 41623 - RNA, 18 nt, Homo sapiens
augaacugaucugcauuc

SEQ ID NO: 41624 - RNA, 22 nt, Homo sapiens
cacaguuaucuuacugaaaaug

SEQ ID NO: 41625 - RNA, 22 nt, Homo sapiens
cacucaaaucuauaugugccag

SEQ ID NO: 41626 - RNA, 20 nt, Homo sapiens
ccucuggcucgcaccggcuc

SEQ ID NO: 41627 - RNA, 23 nt, Homo sapiens
gcuuuguuuguaaacuuaccagu

SEQ ID NO: 41628 - RNA, 18 nt, Homo sapiens
uagcacauggcaauacca

SEQ ID NO: 41629 - RNA, 20 nt, Homo sapiens
uauuuuccaagagcacaccu

SEQ ID NO: 41630 - RNA, 22 nt, Homo sapiens
uccauuggauugcaccuuuaaa

SEQ ID NO: 41631 - RNA, 22 nt, Homo sapiens
ugacaagggccauaaauugcua

SEQ ID NO: 41632 - RNA, 18 nt, Homo sapiens
uuuuucagcaucacuuca

SEQ ID NO: 41633 - RNA, 22 nt, Homo sapiens
aacagauuuuuaaaaacauuga

SEQ ID NO: 41634 - RNA, 24 nt, Homo sapiens
uaaacagauuuuuaaaaacauuga

SEQ ID NO: 41635 - RNA, 18 nt, Homo sapiens
cagcaggauuuuuaugaa

SEQ ID NO: 41636 - RNA, 23 nt, Homo sapiens
ucuuggcuagagaaaaccugugg

SEQ ID NO: 41637 - RNA, 21 nt, Homo sapiens
cagaaaguuacauugcuuugu

SEQ ID NO: 41638 - RNA, 20 nt, Homo sapiens
ccacccccacccccaccccc

SEQ ID NO: 41639 - RNA, 22 nt, Homo sapiens
cggccuucacggcgcaggcggc

SEQ ID NO: 41640 - RNA, 20 nt, Homo sapiens
gcgcacaccaccggcaugac

SEQ ID NO: 41641 - RNA, 20 nt, Homo sapiens
acacggugccuggaagacca

SEQ ID NO: 41642 - RNA, 17 nt, Homo sapiens
aggaagccuggauccca

SEQ ID NO: 41643 - RNA, 18 nt, Homo sapiens
cccugaggaggggccugc

SEQ ID NO: 41644 - RNA, 17 nt, Homo sapiens
ccugcaggacgcuggca

SEQ ID NO: 41645 - RNA, 18 nt, Homo sapiens
gauacaacauacugcaca

SEQ ID NO: 41646 - RNA, 25 nt, Homo sapiens
gccccuugcuggaggguucugggga

SEQ ID NO: 41647 - RNA, 22 nt, Homo sapiens
uggccaccgucacccacagggg

SEQ ID NO: 41648 - RNA, 18 nt, Homo sapiens
cuccccuucauauauaca

SEQ ID NO: 41649 - RNA, 24 nt, Homo sapiens
uaauauugagugucaacuugauug

SEQ ID NO: 41650 - RNA, 18 nt, Homo sapiens
gauauccuugauauugga

SEQ ID NO: 41651 - RNA, 18 nt, Homo sapiens
aacaucaaggccaccaca

SEQ ID NO: 41652 - RNA, 17 nt, Homo sapiens
aggaacagaacgaggca

SEQ ID NO: 41653 - RNA, 22 nt, Homo sapiens
caaagaaaacauucaauaucca

SEQ ID NO: 41654 - RNA, 18 nt, Homo sapiens
caaggccuggccaauugg

SEQ ID NO: 41655 - RNA, 19 nt, Homo sapiens
cagaggacacaccuuguca

SEQ ID NO: 41656 - RNA, 20 nt, Homo sapiens
caucaucauguaccaagcca

SEQ ID NO: 41657 - RNA, 17 nt, Homo sapiens
cauucauuaucacgaug

SEQ ID NO: 41658 - RNA, 18 nt, Homo sapiens
ccugcaaccuccaccucc

SEQ ID NO: 41659 - RNA, 20 nt, Homo sapiens
cucccggccccucugccccu

SEQ ID NO: 41660 - RNA, 20 nt, Homo sapiens
guggagaucuagccagguca

SEQ ID NO: 41661 - RNA, 21 nt, Homo sapiens
uccuggcucaggccuggcgag

SEQ ID NO: 41662 - RNA, 19 nt, Homo sapiens
ugucucccagcagagacua

SEQ ID NO: 41663 - RNA, 23 nt, Homo sapiens
uuccauguauugaaauauccaga

SEQ ID NO: 41664 - RNA, 22 nt, Homo sapiens
uuugacagggggagaaacagaa

SEQ ID NO: 41665 - RNA, 26 nt, Homo sapiens
acgaaaacagccagcaucuuugcuua

SEQ ID NO: 41666 - RNA, 16 nt, Homo sapiens
agccaggauuucccuc

SEQ ID NO: 41667 - RNA, 21 nt, Homo sapiens
auuaaacucauuauuucuuaa

SEQ ID NO: 41668 - RNA, 23 nt, Homo sapiens
cuucagguugaacaguagcuuca

SEQ ID NO: 41669 - RNA, 20 nt, Homo sapiens
cuucuguuagacucacuuuu

SEQ ID NO: 41670 - RNA, 22 nt, Homo sapiens
ugcggggguggggacggcggug

SEQ ID NO: 41671 - RNA, 19 nt, Homo sapiens
agauuuuguaucaugccau

SEQ ID NO: 41672 - RNA, 17 nt, Homo sapiens
aggcagaaggaucacuu

SEQ ID NO: 41673 - RNA, 19 nt, Homo sapiens
agucuuaucauccauauca

SEQ ID NO: 41674 - RNA, 17 nt, Homo sapiens
gccuugcugucuggcuu

SEQ ID NO: 41675 - RNA, 19 nt, Homo sapiens
guaaucauauacauaguca

SEQ ID NO: 41676 - RNA, 19 nt, Homo sapiens
ucagcaggucacugaugaa

SEQ ID NO: 41677 - RNA, 19 nt, Homo sapiens
ucauaaguccauggaccaa

SEQ ID NO: 41678 - RNA, 18 nt, Homo sapiens
uguguugugauacuggaa

SEQ ID NO: 41679 - RNA, 23 nt, Homo sapiens
aagcaacaugauuuccccaucca

SEQ ID NO: 41680 - RNA, 18 nt, Homo sapiens
cauaucccuccugugcuc

SEQ ID NO: 41681 - RNA, 22 nt, Homo sapiens
gagccaagaucgugccacugca

SEQ ID NO: 41682 - RNA, 21 nt, Homo sapiens
ugcccagaagucaaaguccag

SEQ ID NO: 41683 - RNA, 18 nt, Homo sapiens
ugugccaggggugugcug

SEQ ID NO: 41684 - RNA, 19 nt, Homo sapiens
guugccagaaucagacugc

SEQ ID NO: 41685 - RNA, 18 nt, Homo sapiens
uauugcguuuggauucuu

SEQ ID NO: 41686 - RNA, 21 nt, Homo sapiens
cagacauaauaacuacacuca

SEQ ID NO: 41687 - RNA, 22 nt, Homo sapiens
uuucuuuauuccauguucuaua

SEQ ID NO: 41688 - RNA, 17 nt, Homo sapiens
aaaccauccauucacug

SEQ ID NO: 41689 - RNA, 18 nt, Homo sapiens
aagaaaaccauccauuca

SEQ ID NO: 41690 - RNA, 21 nt, Homo sapiens
accacaaaaaacccuccaucc

SEQ ID NO: 41691 - RNA, 18 nt, Homo sapiens
cuggggacugccuguuuc

SEQ ID NO: 41692 - RNA, 17 nt, Homo sapiens
gcacccgcucaugugcu

SEQ ID NO: 41693 - RNA, 21 nt, Homo sapiens
ucuaagaaaaccauccauuca

SEQ ID NO: 41694 - RNA, 24 nt, Homo sapiens
uggagcaauuuccagcagaaguug

SEQ ID NO: 41695 - RNA, 22 nt, Homo sapiens
aacaaaaaggaggaccacgcaa

SEQ ID NO: 41696 - RNA, 21 nt, Homo sapiens
agacuaccucucuagauuucu

SEQ ID NO: 41697 - RNA, 16 nt, Homo sapiens
caaaggucaacaacau

SEQ ID NO: 41698 - RNA, 18 nt, Homo sapiens
ccugcaaccuccaccucc

SEQ ID NO: 41699 - RNA, 19 nt, Homo sapiens
cugcaaccuccaccuccca

SEQ ID NO: 41700 - RNA, 23 nt, Homo sapiens
guucaucugauugggacugguua

SEQ ID NO: 41701 - RNA, 18 nt, Homo sapiens
uccaccucccagguucaa

SEQ ID NO: 41702 - RNA, 20 nt, Homo sapiens
gccagcucugccccacaggg

SEQ ID NO: 41703 - RNA, 17 nt, Homo sapiens
guggcuccagccagcuc

SEQ ID NO: 41704 - RNA, 20 nt, Homo sapiens
auuaaauucacugugguucc

SEQ ID NO: 41705 - RNA, 21 nt, Homo sapiens
ccuugacugcaggcuugggag

SEQ ID NO: 41706 - RNA, 18 nt, Homo sapiens
cucaaaagaauuaacucu

SEQ ID NO: 41707 - RNA, 17 nt, Homo sapiens
uagggaaacacgaagau

SEQ ID NO: 41708 - RNA, 20 nt, Homo sapiens
ugcgaugggccgcacauuuu

SEQ ID NO: 41709 - RNA, 19 nt, Homo sapiens
uuuauaugccugugucagc

SEQ ID NO: 41710 - RNA, 18 nt, Homo sapiens
aaauggauucucaguuug

SEQ ID NO: 41711 - RNA, 16 nt, Homo sapiens
aaucugggcaagagga

SEQ ID NO: 41712 - RNA, 21 nt, Homo sapiens
aggaaagagaaauaggcccuu

SEQ ID NO: 41713 - RNA, 24 nt, Homo sapiens
aggauaauuugcauauccaucacc

SEQ ID NO: 41714 - RNA, 18 nt, Homo sapiens
aguauugcauaacuuuaa

SEQ ID NO: 41715 - RNA, 19 nt, Homo sapiens
auccuggugguaggucucu

SEQ ID NO: 41716 - RNA, 20 nt, Homo sapiens
caaaggauauaaaugacuaa

SEQ ID NO: 41717 - RNA, 23 nt, Homo sapiens
cccuagaagcagagcuggaguaa

SEQ ID NO: 41718 - RNA, 18 nt, Homo sapiens
ccugagccugcauggccu

SEQ ID NO: 41719 - RNA, 18 nt, Homo sapiens
gccauaucacugagggua

SEQ ID NO: 41720 - RNA, 17 nt, Homo sapiens
ggaucaggcagcuccaa

SEQ ID NO: 41721 - RNA, 17 nt, Homo sapiens
gugugauauuuucauac

SEQ ID NO: 41722 - RNA, 20 nt, Homo sapiens
uacccugaauccugcacuuu

SEQ ID NO: 41723 - RNA, 19 nt, Homo sapiens
uugggcaguugcauuauuu

SEQ ID NO: 41724 - RNA, 19 nt, Homo sapiens
cuggcaggaaauuugcaaa

SEQ ID NO: 41725 - RNA, 18 nt, Homo sapiens
gugaaaauuauugcgugc

SEQ ID NO: 41726 - RNA, 17 nt, Homo sapiens
ugaucaaguccuugcua

SEQ ID NO: 41727 - RNA, 18 nt, Homo sapiens
aaaaggggguggugauga

SEQ ID NO: 41728 - RNA, 21 nt, Homo sapiens
uaauuuccuuauauugugaua

SEQ ID NO: 41729 - RNA, 17 nt, Homo sapiens
ggcgccuggagcugggc

SEQ ID NO: 41730 - RNA, 26 nt, Homo sapiens
agaugugcaugugagcaagcuuguua

SEQ ID NO: 41731 - RNA, 21 nt, Homo sapiens
caccgaccggucagcuuucca

SEQ ID NO: 41732 - RNA, 21 nt, Homo sapiens
gcuuuccaacaccaacacuga

SEQ ID NO: 41733 - RNA, 20 nt, Homo sapiens
agaaggguauuucuccaccg

SEQ ID NO: 41734 - RNA, 19 nt, Homo sapiens
ccagaaggguauuucucca

SEQ ID NO: 41735 - RNA, 20 nt, Homo sapiens
cgacagaagcugggcgcuuu

SEQ ID NO: 41736 - RNA, 17 nt, Homo sapiens
cuccgccaccgggcuag

SEQ ID NO: 41737 - RNA, 19 nt, Homo sapiens
gagccucggcugaaauccg

SEQ ID NO: 41738 - RNA, 22 nt, Homo sapiens
aggauggccuggaccacacaca

SEQ ID NO: 41739 - RNA, 18 nt, Homo sapiens
caccauucuccugccuca

SEQ ID NO: 41740 - RNA, 18 nt, Homo sapiens
cagcacccgccucacagg

SEQ ID NO: 41741 - RNA, 21 nt, Homo sapiens
ccuaucugggucgcuuggccu

SEQ ID NO: 41742 - RNA, 22 nt, Homo sapiens
cugggauuacaggcaucugcca

SEQ ID NO: 41743 - RNA, 24 nt, Homo sapiens
gcuucucugcccuaguuuugccuu

SEQ ID NO: 41744 - RNA, 19 nt, Homo sapiens
gugccacaaaauaaagcuc

SEQ ID NO: 41745 - RNA, 24 nt, Homo sapiens
uccugauucagcucuucuuaccca

SEQ ID NO: 41746 - RNA, 18 nt, Homo sapiens
ucuaccuccuggguucaa

SEQ ID NO: 41747 - RNA, 20 nt, Homo sapiens
uggccaggcuggucuugaac

SEQ ID NO: 41748 - RNA, 18 nt, Homo sapiens
uccccgacguucuaguua

SEQ ID NO: 41749 - RNA, 18 nt, Homo sapiens
ucuuuagacaacaguguu

SEQ ID NO: 41750 - RNA, 21 nt, Homo sapiens
ugucucuccugcacacauagc

SEQ ID NO: 41751 - RNA, 21 nt, Homo sapiens
ugguuccuagcuguggggcug

SEQ ID NO: 41752 - RNA, 21 nt, Homo sapiens
cauccaguaagaagaccugcc

SEQ ID NO: 41753 - RNA, 20 nt, Homo sapiens
ccacuuggcuagaguucaga

SEQ ID NO: 41754 - RNA, 21 nt, Homo sapiens
gcuugagucuggucugagucu

SEQ ID NO: 41755 - RNA, 19 nt, Homo sapiens
ccugugggucuuuugguuu

SEQ ID NO: 41756 - RNA, 21 nt, Homo sapiens
cuuugagcuaggucuugugag

SEQ ID NO: 41757 - RNA, 23 nt, Homo sapiens
gcuagucucagguguucugggga

SEQ ID NO: 41758 - RNA, 25 nt, Homo sapiens
aaaagaaagaaauugccuuauguca

SEQ ID NO: 41759 - RNA, 17 nt, Homo sapiens
ccuucuuccccuuaucc

SEQ ID NO: 41760 - RNA, 18 nt, Homo sapiens
cucuccuuuggauaucug

SEQ ID NO: 41761 - RNA, 17 nt, Homo sapiens
cugcauggugcuucguc

SEQ ID NO: 41762 - RNA, 20 nt, Homo sapiens
uccuccuuuccccucuccuu

SEQ ID NO: 41763 - RNA, 22 nt, Homo sapiens
cccccaguuggggggccuagac

SEQ ID NO: 41764 - RNA, 18 nt, Homo sapiens
cgagccagcagccgagcu

SEQ ID NO: 41765 - RNA, 21 nt, Homo sapiens
cgggcggggccggagcccggc

SEQ ID NO: 41766 - RNA, 23 nt, Homo sapiens
ucugcccagccggcccccaccuc

SEQ ID NO: 41767 - RNA, 20 nt, Homo sapiens
ugcuucacagaugugccagc

SEQ ID NO: 41768 - RNA, 18 nt, Homo sapiens
uggugaagacacuccugc

SEQ ID NO: 41769 - RNA, 21 nt, Homo sapiens
uugagacauaauaguagcuca

SEQ ID NO: 41770 - RNA, 23 nt, Homo sapiens
agcuguaugcguucuagcuguau

SEQ ID NO: 41771 - RNA, 18 nt, Homo sapiens
cacugguagcuccugucc

SEQ ID NO: 41772 - RNA, 22 nt, Homo sapiens
ucugagcugauucuguuugcuc

SEQ ID NO: 41773 - RNA, 19 nt, Homo sapiens
agaagauauacaaauauua

SEQ ID NO: 41774 - RNA, 18 nt, Homo sapiens
auacaaauguucauagca

SEQ ID NO: 41775 - RNA, 19 nt, Homo sapiens
caugaaugagccucagaaa

SEQ ID NO: 41776 - RNA, 19 nt, Homo sapiens
acaaaaugacauucccuca

SEQ ID NO: 41777 - RNA, 18 nt, Homo sapiens
agagauugagacaaaaug

SEQ ID NO: 41778 - RNA, 20 nt, Homo sapiens
auaaaguuccucccaguucc

SEQ ID NO: 41779 - RNA, 21 nt, Homo sapiens
acuugaacucugguuuggcuu

SEQ ID NO: 41780 - RNA, 18 nt, Homo sapiens
augaccuucuaccaguug

SEQ ID NO: 41781 - RNA, 21 nt, Homo sapiens
auguaaggccuugguaaguga

SEQ ID NO: 41782 - RNA, 21 nt, Homo sapiens
cacuguugugggagggaccca

SEQ ID NO: 41783 - RNA, 18 nt, Homo sapiens
cucauugagucauccaac

SEQ ID NO: 41784 - RNA, 18 nt, Homo sapiens
cuuuuuccauuggucuaa

SEQ ID NO: 41785 - RNA, 16 nt, Homo sapiens
gccucucccuugcugu

SEQ ID NO: 41786 - RNA, 26 nt, Homo sapiens
ggcaaagugcaacugcagccagcuca

SEQ ID NO: 41787 - RNA, 18 nt, Homo sapiens
guauuuauagagcaaccg

SEQ ID NO: 41788 - RNA, 17 nt, Homo sapiens
ugaauguuaguguccuu

SEQ ID NO: 41789 - RNA, 18 nt, Homo sapiens
ccaaagugcaaagugaca

SEQ ID NO: 41790 - RNA, 19 nt, Homo sapiens
cuaaucauucaccacagca

SEQ ID NO: 41791 - RNA, 23 nt, Homo sapiens
uaagugggcucuaggggaaggua

SEQ ID NO: 41792 - RNA, 19 nt, Homo sapiens
uauaacaaggggaaaaaac

SEQ ID NO: 41793 - RNA, 17 nt, Homo sapiens
agguaguucaguccacu

SEQ ID NO: 41794 - RNA, 23 nt, Homo sapiens
cccaccaagcuuauaugcugcca

SEQ ID NO: 41795 - RNA, 21 nt, Homo sapiens
ggacuuggcaccuggaauaca

SEQ ID NO: 41796 - RNA, 20 nt, Homo sapiens
uugauauaaauguauuuuua

SEQ ID NO: 41797 - RNA, 19 nt, Homo sapiens
agaaacaugcagcagucuc

SEQ ID NO: 41798 - RNA, 19 nt, Homo sapiens
agagagaaucagguaccuu

SEQ ID NO: 41799 - RNA, 24 nt, Homo sapiens
cagaacuacaguuccauugucucg

SEQ ID NO: 41800 - RNA, 15 nt, Homo sapiens
cagcagcagcagcca

SEQ ID NO: 41801 - RNA, 23 nt, Homo sapiens
ccaaggcuuugccucuuuacagc

SEQ ID NO: 41802 - RNA, 21 nt, Homo sapiens
ccagucuucaccuccacaccc

SEQ ID NO: 41803 - RNA, 20 nt, Homo sapiens
cccgaauccuccccaacaag

SEQ ID NO: 41804 - RNA, 17 nt, Homo sapiens
cccuaccagcagcagca

SEQ ID NO: 41805 - RNA, 18 nt, Homo sapiens
cgagaacaaagacucuga

SEQ ID NO: 41806 - RNA, 17 nt, Homo sapiens
cuccagaaucuccaguc

SEQ ID NO: 41807 - RNA, 20 nt, Homo sapiens
gaaauuuaccauacauauca

SEQ ID NO: 41808 - RNA, 22 nt, Homo sapiens
gcaccagcagcccauccacccc

SEQ ID NO: 41809 - RNA, 18 nt, Homo sapiens
gcuguggccuccacguca

SEQ ID NO: 41810 - RNA, 22 nt, Homo sapiens
ggcuuugagggcaaacaccuca

SEQ ID NO: 41811 - RNA, 20 nt, Homo sapiens
acugucagcaggcagugacc

SEQ ID NO: 41812 - RNA, 18 nt, Homo sapiens
caaauagcacgcugaauu

SEQ ID NO: 41813 - RNA, 24 nt, Homo sapiens
ccucaggagguuguacuuaauuuu

SEQ ID NO: 41814 - RNA, 20 nt, Homo sapiens
ccugcucccaaauggcaagg

SEQ ID NO: 41815 - RNA, 23 nt, Homo sapiens
uagaaacaugaaaccaugcacuu

SEQ ID NO: 41816 - RNA, 18 nt, Homo sapiens
uguaaauauauauauuca

SEQ ID NO: 41817 - RNA, 23 nt, Homo sapiens
gcuuucuauuccccccugccucu

SEQ ID NO: 41818 - RNA, 22 nt, Homo sapiens
ugaccgcuccaguucucaucau

SEQ ID NO: 41819 - RNA, 25 nt, Homo sapiens
aauggacuaagacacacauugucaa

SEQ ID NO: 41820 - RNA, 22 nt, Homo sapiens
accuggauuuaaauccuggcuu

SEQ ID NO: 41821 - RNA, 17 nt, Homo sapiens
ccugaccaguuuugcgg

SEQ ID NO: 41822 - RNA, 23 nt, Homo sapiens
ccuggcaucguacaccagcacca

SEQ ID NO: 41823 - RNA, 18 nt, Homo sapiens
guccuucaagaggaccuc

SEQ ID NO: 41824 - RNA, 17 nt, Homo sapiens
cguuuuacaaauaauua

SEQ ID NO: 41825 - RNA, 18 nt, Homo sapiens
uggauggacuccagaggg

SEQ ID NO: 41826 - RNA, 19 nt, Homo sapiens
ccagcaagauuuuaagcug

SEQ ID NO: 41827 - RNA, 21 nt, Homo sapiens
ugaguuucaaauguggaacug

SEQ ID NO: 41828 - RNA, 19 nt, Homo sapiens
uuggcuguaacucacuuuu

SEQ ID NO: 41829 - RNA, 19 nt, Homo sapiens
ggcauaggucaucacugca

SEQ ID NO: 41830 - RNA, 27 nt, Homo sapiens
gugguugggcaagagagugucuuuguu

SEQ ID NO: 41831 - RNA, 18 nt, Homo sapiens
gauuaaaagaagaguuga

SEQ ID NO: 41832 - RNA, 18 nt, Homo sapiens
gggacaauuugguuuuaa

SEQ ID NO: 41833 - RNA, 20 nt, Homo sapiens
ucauauguuuguucuugcaa

SEQ ID NO: 41834 - RNA, 25 nt, Homo sapiens
aucuccaugacgaugguguuaagga

SEQ ID NO: 41835 - RNA, 20 nt, Homo sapiens
cguguggagugagaaacccg

SEQ ID NO: 41836 - RNA, 19 nt, Homo sapiens
gcauacaagaaaacugcca

SEQ ID NO: 41837 - RNA, 22 nt, Homo sapiens
gcuugagcugggacuuggcacc

SEQ ID NO: 41838 - RNA, 17 nt, Homo sapiens
uccaugacgaugguguu

SEQ ID NO: 41839 - RNA, 19 nt, Homo sapiens
ugagguuauggguguuggu

SEQ ID NO: 41840 - RNA, 20 nt, Homo sapiens
ugggaggugacuaggcuuag

SEQ ID NO: 41841 - RNA, 19 nt, Homo sapiens
uuccacugaaaccucuguu

SEQ ID NO: 41842 - RNA, 19 nt, Homo sapiens
ccgcacccugcacugcgua

SEQ ID NO: 41843 - RNA, 24 nt, Homo sapiens
gcaccuuguuucacuccugccucc

SEQ ID NO: 41844 - RNA, 17 nt, Homo sapiens
uguaugcaacaagcuuc

SEQ ID NO: 41845 - RNA, 18 nt, Homo sapiens
aguuguauugaguacagc

SEQ ID NO: 41846 - RNA, 19 nt, Homo sapiens
aucucgaucucuugaucuc

SEQ ID NO: 41847 - RNA, 23 nt, Homo sapiens
aucuucauaacuuccugcucuua

SEQ ID NO: 41848 - RNA, 19 nt, Homo sapiens
cugcaaccuccgccuccca

SEQ ID NO: 41849 - RNA, 21 nt, Homo sapiens
gaauuucauucuuugucauua

SEQ ID NO: 41850 - RNA, 22 nt, Homo sapiens
gauuguucugugaauuguuguu

SEQ ID NO: 41851 - RNA, 21 nt, Homo sapiens
uaagaaauagcauuuuacucu

SEQ ID NO: 41852 - RNA, 18 nt, Homo sapiens
uccgccucccagguucaa

SEQ ID NO: 41853 - RNA, 18 nt, Homo sapiens
ugauccagcagugucgaa

SEQ ID NO: 41854 - RNA, 19 nt, Homo sapiens
aaucaacuauuaaacagug

SEQ ID NO: 41855 - RNA, 18 nt, Homo sapiens
cacucuguuacucauuuu

SEQ ID NO: 41856 - RNA, 18 nt, Homo sapiens
uacuggaugggucaaacu

SEQ ID NO: 41857 - RNA, 17 nt, Homo sapiens
ugccuuggaguggacuu

SEQ ID NO: 41858 - RNA, 25 nt, Homo sapiens
aucucucucuguggcuguugggccc

SEQ ID NO: 41859 - RNA, 18 nt, Homo sapiens
cuguccucugagaagcca

SEQ ID NO: 41860 - RNA, 22 nt, Homo sapiens
gcucgucgucugacaucagcua

SEQ ID NO: 41861 - RNA, 21 nt, Homo sapiens
uccuggugaugggggguuccu

SEQ ID NO: 41862 - RNA, 23 nt, Homo sapiens
uccuuagcuuuugaagcuccuca

SEQ ID NO: 41863 - RNA, 22 nt, Homo sapiens
uucccagucacacaaccaggga

SEQ ID NO: 41864 - RNA, 20 nt, Homo sapiens
acagucucaggugcuguguu

SEQ ID NO: 41865 - RNA, 18 nt, Homo sapiens
ccacgggagcucugggga

SEQ ID NO: 41866 - RNA, 22 nt, Homo sapiens
ccuggguaauuuuuguauuuuu

SEQ ID NO: 41867 - RNA, 18 nt, Homo sapiens
cugccucagguugacaga

SEQ ID NO: 41868 - RNA, 18 nt, Homo sapiens
gacauauuauaugccuuu

SEQ ID NO: 41869 - RNA, 17 nt, Homo sapiens
ucaagugauucuccugc

SEQ ID NO: 41870 - RNA, 18 nt, Homo sapiens
ucuccuugcguuucagug

SEQ ID NO: 41871 - RNA, 20 nt, Homo sapiens
aaagcaaaggcaaauagugc

SEQ ID NO: 41872 - RNA, 22 nt, Homo sapiens
aacagaccuuaaaagguauuga

SEQ ID NO: 41873 - RNA, 23 nt, Homo sapiens
aacuagcaugggaugcacugcac

SEQ ID NO: 41874 - RNA, 24 nt, Homo sapiens
acaccacuggguuuuggugugaga

SEQ ID NO: 41875 - RNA, 21 nt, Homo sapiens
acagagucagccccugggcca

SEQ ID NO: 41876 - RNA, 18 nt, Homo sapiens
acauuauauuacauuaua

SEQ ID NO: 41877 - RNA, 18 nt, Homo sapiens
accacugaaaucauucua

SEQ ID NO: 41878 - RNA, 19 nt, Homo sapiens
acucaucucuccaagcagg

SEQ ID NO: 41879 - RNA, 20 nt, Homo sapiens
aggcuauacaauguguguga

SEQ ID NO: 41880 - RNA, 19 nt, Homo sapiens
cagcagcagcaacagcagc

SEQ ID NO: 41881 - RNA, 20 nt, Homo sapiens
cagugcccaccccuguuaua

SEQ ID NO: 41882 - RNA, 20 nt, Homo sapiens
cgaacugcaauaaaugugaa

SEQ ID NO: 41883 - RNA, 19 nt, Homo sapiens
ggccgggugcgguggcuca

SEQ ID NO: 41884 - RNA, 20 nt, Homo sapiens
uaagguccugugggccuagu

SEQ ID NO: 41885 - RNA, 20 nt, Homo sapiens
uaggcuucaucaugcauuuc

SEQ ID NO: 41886 - RNA, 21 nt, Homo sapiens
uccaaaagcuaaaugauuuaa

SEQ ID NO: 41887 - RNA, 19 nt, Homo sapiens
uuuauuuguacagcaguua

SEQ ID NO: 41888 - RNA, 20 nt, Homo sapiens
cuguggugggccucuggccc

SEQ ID NO: 41889 - RNA, 24 nt, Homo sapiens
cuucucaccucgcccccuugcaca

SEQ ID NO: 41890 - RNA, 17 nt, Homo sapiens
uauauaucguguucgac

SEQ ID NO: 41891 - RNA, 23 nt, Homo sapiens
uccacggauggcuucuuccuuca

SEQ ID NO: 41892 - RNA, 18 nt, Homo sapiens
acaacccaucaagcggag

SEQ ID NO: 41893 - RNA, 19 nt, Homo sapiens
agcugugggcaagagguca

SEQ ID NO: 41894 - RNA, 23 nt, Homo sapiens
agugccugacccugaccuguccu

SEQ ID NO: 41895 - RNA, 22 nt, Homo sapiens
ccccaccccacccagccgugua

SEQ ID NO: 41896 - RNA, 17 nt, Homo sapiens
cucuccugcccugccuu

SEQ ID NO: 41897 - RNA, 23 nt, Homo sapiens
cuuagcauccuuugaucauuuuu

SEQ ID NO: 41898 - RNA, 19 nt, Homo sapiens
ggugggguuggagccccca

SEQ ID NO: 41899 - RNA, 17 nt, Homo sapiens
uccacuccaaagugggu

SEQ ID NO: 41900 - RNA, 20 nt, Homo sapiens
ugcgcgucugugcaugugug

SEQ ID NO: 41901 - RNA, 23 nt, Homo sapiens
uguuuacaagaugacuaauucua

SEQ ID NO: 41902 - RNA, 23 nt, Homo sapiens
cccucccccacuugccaccaucc

SEQ ID NO: 41903 - RNA, 23 nt, Homo sapiens
gccauuucaucuggagcuuucaa

SEQ ID NO: 41904 - RNA, 18 nt, Homo sapiens
ucaucgcaaacaguauua

SEQ ID NO: 41905 - RNA, 18 nt, Homo sapiens
ucccagaguugcugcaag

SEQ ID NO: 41906 - RNA, 18 nt, Homo sapiens
ugggaaggaugugucugc

SEQ ID NO: 41907 - RNA, 22 nt, Homo sapiens
gccugggcucagagucaggcuu

SEQ ID NO: 41908 - RNA, 17 nt, Homo sapiens
aaucaagaccucauuac

SEQ ID NO: 41909 - RNA, 22 nt, Homo sapiens
agagcaucucuuccaucccuca

SEQ ID NO: 41910 - RNA, 19 nt, Homo sapiens
gucccacugcuaacaagcc

SEQ ID NO: 41911 - RNA, 25 nt, Homo sapiens
ugaacuuuagcacuugaagaacuga

SEQ ID NO: 41912 - RNA, 19 nt, Homo sapiens
ugaagaugacaccuccucu

SEQ ID NO: 41913 - RNA, 26 nt, Homo sapiens
ugccauuucucugugcccuuuugaca

SEQ ID NO: 41914 - RNA, 22 nt, Homo sapiens
ccccuccaagugucuguuccag

SEQ ID NO: 41915 - RNA, 18 nt, Homo sapiens
uccaagugucuguuccag

SEQ ID NO: 41916 - RNA, 18 nt, Homo sapiens
ugaaaagacaucagagua

SEQ ID NO: 41917 - RNA, 22 nt, Homo sapiens
gagccaagaucgcgccacugca

SEQ ID NO: 41918 - RNA, 20 nt, Homo sapiens
gcauauuuggugguaaccua

SEQ ID NO: 41919 - RNA, 19 nt, Homo sapiens
aauuauacaauacuugucc

SEQ ID NO: 41920 - RNA, 19 nt, Homo sapiens
acguacagaaaauuugcca

SEQ ID NO: 41921 - RNA, 19 nt, Homo sapiens
auauugcugucaguuccuc

SEQ ID NO: 41922 - RNA, 17 nt, Homo sapiens
caaaaugucaucacccu

SEQ ID NO: 41923 - RNA, 19 nt, Homo sapiens
cuucuccuucccuuccccu

SEQ ID NO: 41924 - RNA, 20 nt, Homo sapiens
cuuccuguguccccucugcc

SEQ ID NO: 41925 - RNA, 23 nt, Homo sapiens
uucaggagcuuacauuuuacuca

SEQ ID NO: 41926 - RNA, 20 nt, Homo sapiens
caucuuccagggcaaaacca

SEQ ID NO: 41927 - RNA, 19 nt, Homo sapiens
ccaguaagaccaucuuuca

SEQ ID NO: 41928 - RNA, 19 nt, Homo sapiens
cauguggcucgugcuggga

SEQ ID NO: 41929 - RNA, 17 nt, Homo sapiens
cucaccucucugccucu

SEQ ID NO: 41930 - RNA, 22 nt, Homo sapiens
acccagaggaggagagaacccg

SEQ ID NO: 41931 - RNA, 17 nt, Homo sapiens
agaaaaugauuaaaaua

SEQ ID NO: 41932 - RNA, 17 nt, Homo sapiens
aggcagaagaaucacuu

SEQ ID NO: 41933 - RNA, 19 nt, Homo sapiens
ccagaaaugcugugaucag

SEQ ID NO: 41934 - RNA, 21 nt, Homo sapiens
guacuacuguuuacuaccaua

SEQ ID NO: 41935 - RNA, 22 nt, Homo sapiens
uacuaccaccaaauuuuaccau

SEQ ID NO: 41936 - RNA, 16 nt, Homo sapiens
agaaugagaagccagu

SEQ ID NO: 41937 - RNA, 19 nt, Homo sapiens
auuaucauggcaucaucau

SEQ ID NO: 41938 - RNA, 18 nt, Homo sapiens
caucauccucugauguuu

SEQ ID NO: 41939 - RNA, 21 nt, Homo sapiens
ugauaagacucccauuuagac

SEQ ID NO: 41940 - RNA, 23 nt, Homo sapiens
aucugcccugugccgccugguuc

SEQ ID NO: 41941 - RNA, 22 nt, Homo sapiens
gcccugguuauugcugagcucu

SEQ ID NO: 41942 - RNA, 20 nt, Homo sapiens
uggccuccagcaugagccug

SEQ ID NO: 41943 - RNA, 18 nt, Homo sapiens
caccaccacacccugcua

SEQ ID NO: 41944 - RNA, 20 nt, Homo sapiens
ccagaaccaaaccccccuca

SEQ ID NO: 41945 - RNA, 18 nt, Homo sapiens
cccucagucaacguuuca

SEQ ID NO: 41946 - RNA, 22 nt, Homo sapiens
gaaaacauuggcggcagcaggu

SEQ ID NO: 41947 - RNA, 21 nt, Homo sapiens
gccuggaaacaugcuuggcuc

SEQ ID NO: 41948 - RNA, 22 nt, Homo sapiens
uccccgccaccccacgcacuca

SEQ ID NO: 41949 - RNA, 17 nt, Homo sapiens
uccuccccgccacccca

SEQ ID NO: 41950 - RNA, 16 nt, Homo sapiens
uuaagugauccaccca

SEQ ID NO: 41951 - RNA, 18 nt, Homo sapiens
uucuccugccucagccuu

SEQ ID NO: 41952 - RNA, 21 nt, Homo sapiens
auaugugcaugucuauaacuc

SEQ ID NO: 41953 - RNA, 18 nt, Homo sapiens
uagagguacuauuucaau

SEQ ID NO: 41954 - RNA, 21 nt, Homo sapiens
uccacauuacuuauguacuca

SEQ ID NO: 41955 - RNA, 19 nt, Homo sapiens
ugggcauucucuugagaga

SEQ ID NO: 41956 - RNA, 19 nt, Homo sapiens
gaauggaagccaggagcuc

SEQ ID NO: 41957 - RNA, 21 nt, Homo sapiens
gucauggucgccuagcgcuca

SEQ ID NO: 41958 - RNA, 18 nt, Homo sapiens
ucauucuaggcaauccac

SEQ ID NO: 41959 - RNA, 16 nt, Homo sapiens
uucuaggcaauccacc

SEQ ID NO: 41960 - RNA, 22 nt, Homo sapiens
gauugcaucaagagccauggua

SEQ ID NO: 41961 - RNA, 25 nt, Homo sapiens
uugaccacugaguuaucacauccca

SEQ ID NO: 41962 - RNA, 20 nt, Homo sapiens
aauauaaucauuccauccca

SEQ ID NO: 41963 - RNA, 18 nt, Homo sapiens
aaucuagguggaagccac

SEQ ID NO: 41964 - RNA, 17 nt, Homo sapiens
ccugagccuguccucca

SEQ ID NO: 41965 - RNA, 23 nt, Homo sapiens
ccuuaaagcuaugagccuuuaaa

SEQ ID NO: 41966 - RNA, 21 nt, Homo sapiens
cuuuuccccauugccuuaacu

SEQ ID NO: 41967 - RNA, 16 nt, Homo sapiens
ggccaggaguuuguua

SEQ ID NO: 41968 - RNA, 19 nt, Homo sapiens
ucuccugaaaaugcuuuuu

SEQ ID NO: 41969 - RNA, 26 nt, Homo sapiens
uggggaucaaauuucaacaugagguu

SEQ ID NO: 41970 - RNA, 20 nt, Homo sapiens
agcuccuccugcucguugau

SEQ ID NO: 41971 - RNA, 24 nt, Homo sapiens
cagcugugacucaagggcccagga

SEQ ID NO: 41972 - RNA, 19 nt, Homo sapiens
ccagggaaucugugcucac

SEQ ID NO: 41973 - RNA, 23 nt, Homo sapiens
cccauggccauggaauaaaugcc

SEQ ID NO: 41974 - RNA, 19 nt, Homo sapiens
ccaugacccuuccaagcca

SEQ ID NO: 41975 - RNA, 16 nt, Homo sapiens
ccuacuguaacuuuaa

SEQ ID NO: 41976 - RNA, 18 nt, Homo sapiens
uauagcucuuagccauga

SEQ ID NO: 41977 - RNA, 19 nt, Homo sapiens
ugccaauaccaccuacugu

SEQ ID NO: 41978 - RNA, 18 nt, Homo sapiens
uuagagccuuuguccucu

SEQ ID NO: 41979 - RNA, 23 nt, Homo sapiens
uucuuuggguccgugggcuugug

SEQ ID NO: 41980 - RNA, 21 nt, Homo sapiens
aagugugaaaucaagauguca

SEQ ID NO: 41981 - RNA, 18 nt, Homo sapiens
aggagagaacccagaaua

SEQ ID NO: 41982 - RNA, 20 nt, Homo sapiens
aguuggacucguagguacug

SEQ ID NO: 41983 - RNA, 22 nt, Homo sapiens
cagcacgguggcaauuucccuc

SEQ ID NO: 41984 - RNA, 25 nt, Homo sapiens
gaacaaauaucaaacacugaccuca

SEQ ID NO: 41985 - RNA, 21 nt, Homo sapiens
gaacccagaauaaaccacugg

SEQ ID NO: 41986 - RNA, 22 nt, Homo sapiens
guggcuuccuuggcuugucguc

SEQ ID NO: 41987 - RNA, 21 nt, Homo sapiens
ugccugggccuccugcuccag

SEQ ID NO: 41988 - RNA, 22 nt, Homo sapiens
uucaagugucaacuuuacuuca

SEQ ID NO: 41989 - RNA, 18 nt, Homo sapiens
uuguugaaaacaauaggg

SEQ ID NO: 41990 - RNA, 20 nt, Homo sapiens
uuugaaacaagaccacuucu

SEQ ID NO: 41991 - RNA, 18 nt, Homo sapiens
acccaaaaggaaaaucuu

SEQ ID NO: 41992 - RNA, 16 nt, Homo sapiens
cagcucgaguuguggg

SEQ ID NO: 41993 - RNA, 19 nt, Homo sapiens
aagcaauucuccugccuca

SEQ ID NO: 41994 - RNA, 20 nt, Homo sapiens
acauaauccugaauguugaa

SEQ ID NO: 41995 - RNA, 20 nt, Homo sapiens
acuuccucaguaaaggaaga

SEQ ID NO: 41996 - RNA, 21 nt, Homo sapiens
aguuucaacaaaagcuuagca

SEQ ID NO: 41997 - RNA, 20 nt, Homo sapiens
auuucagaugacugcaguua

SEQ ID NO: 41998 - RNA, 21 nt, Homo sapiens
cuccaaaaggauagcugccau

SEQ ID NO: 41999 - RNA, 20 nt, Homo sapiens
cuuugacuagcaaggcuugu

SEQ ID NO: 42000 - RNA, 24 nt, Homo sapiens
guguaugugagucucaguggacua

SEQ ID NO: 42001 - RNA, 20 nt, Homo sapiens
uggccaggcuggucuugaac

SEQ ID NO: 42002 - RNA, 23 nt, Homo sapiens
uugagggguccagcuccucauca

SEQ ID NO: 42003 - RNA, 15 nt, Homo sapiens
aagcaauucuccuuc

SEQ ID NO: 42004 - RNA, 18 nt, Homo sapiens
aauuaagaaugaagaggg

SEQ ID NO: 42005 - RNA, 22 nt, Homo sapiens
ccaggaaccaguuccuuaauga

SEQ ID NO: 42006 - RNA, 23 nt, Homo sapiens
ccuuuuuauggcuaaaugauguu

SEQ ID NO: 42007 - RNA, 18 nt, Homo sapiens
gacguguuuuaacagcaa

SEQ ID NO: 42008 - RNA, 21 nt, Homo sapiens
gagccaugacgccuggccuca

SEQ ID NO: 42009 - RNA, 19 nt, Homo sapiens
gcaucuaaugaaaauuuca

SEQ ID NO: 42010 - RNA, 21 nt, Homo sapiens
guuuuacuuuagauuaacuaa

SEQ ID NO: 42011 - RNA, 18 nt, Homo sapiens
uccgccuccuggguucaa

SEQ ID NO: 42012 - RNA, 19 nt, Homo sapiens
ucuuggcggcggggggauc

SEQ ID NO: 42013 - RNA, 17 nt, Homo sapiens
uucuuaauauuagucac

SEQ ID NO: 42014 - RNA, 19 nt, Homo sapiens
cacaggcauuguuugcuuu

SEQ ID NO: 42015 - RNA, 18 nt, Homo sapiens
gauuacaucauaagacug

SEQ ID NO: 42016 - RNA, 24 nt, Homo sapiens
uccagggcauggccuuaaaucuca

SEQ ID NO: 42017 - RNA, 18 nt, Homo sapiens
agaaagugacccugauca

SEQ ID NO: 42018 - RNA, 20 nt, Homo sapiens
agauaauaguuguugaaagc

SEQ ID NO: 42019 - RNA, 20 nt, Homo sapiens
caauacauaccaaucaucac

SEQ ID NO: 42020 - RNA, 15 nt, Homo sapiens
ccaggaaaacaugga

SEQ ID NO: 42021 - RNA, 19 nt, Homo sapiens
cuaaugcauuauuaauaua

SEQ ID NO: 42022 - RNA, 18 nt, Homo sapiens
aggcagcaaacuaagcug

SEQ ID NO: 42023 - RNA, 22 nt, Homo sapiens
gagccaagauuuugccacugca

SEQ ID NO: 42024 - RNA, 24 nt, Homo sapiens
acacacagaccccuccccaaucug

SEQ ID NO: 42025 - RNA, 17 nt, Homo sapiens
ccucuguugagcaguca

SEQ ID NO: 42026 - RNA, 22 nt, Homo sapiens
gagccaagaucgugccacugca

SEQ ID NO: 42027 - RNA, 22 nt, Homo sapiens
ggauguuggcaagugccucuua

SEQ ID NO: 42028 - RNA, 19 nt, Homo sapiens
guucuuuaccuuuacuugg

SEQ ID NO: 42029 - RNA, 21 nt, Homo sapiens
ugcagugagccaagaucgugc

SEQ ID NO: 42030 - RNA, 17 nt, Homo sapiens
aacagucugcaagauuc

SEQ ID NO: 42031 - RNA, 23 nt, Homo sapiens
gucauagucacuauggugacuca

SEQ ID NO: 42032 - RNA, 19 nt, Homo sapiens
uccugaagccaucugugga

SEQ ID NO: 42033 - RNA, 18 nt, Homo sapiens
cccccacaccccucccca

SEQ ID NO: 42034 - RNA, 19 nt, Homo sapiens
ccugagccccgcucggccu

SEQ ID NO: 42035 - RNA, 20 nt, Homo sapiens
ucccugcccaggggcaccuc

SEQ ID NO: 42036 - RNA, 20 nt, Homo sapiens
uuaagcauaacauacugaca

SEQ ID NO: 42037 - RNA, 16 nt, Homo sapiens
acgauuggaauucauc

SEQ ID NO: 42038 - RNA, 20 nt, Homo sapiens
ccucugccuccuggguucaa

SEQ ID NO: 42039 - RNA, 20 nt, Homo sapiens
uggccaggcuggucuugaac

SEQ ID NO: 42040 - RNA, 22 nt, Homo sapiens
acaugcuucaaauaaaucagcu

SEQ ID NO: 42041 - RNA, 21 nt, Homo sapiens
gaaaggauauagaugaugaca

SEQ ID NO: 42042 - RNA, 21 nt, Homo sapiens
cagaggacuccagguugcuca

SEQ ID NO: 42043 - RNA, 19 nt, Homo sapiens
cggagcggccaggacacag

SEQ ID NO: 42044 - RNA, 24 nt, Homo sapiens
cugauacauggaacaggcacaucu

SEQ ID NO: 42045 - RNA, 21 nt, Homo sapiens
caaagacugugccacugcacu

SEQ ID NO: 42046 - RNA, 21 nt, Homo sapiens
ccuccagcagcacggaugcug

SEQ ID NO: 42047 - RNA, 16 nt, Homo sapiens
cucgaugagugcucug

SEQ ID NO: 42048 - RNA, 20 nt, Homo sapiens
cuucgcuaaucagcauauca

SEQ ID NO: 42049 - RNA, 19 nt, Homo sapiens
gcugaggaaaaaguaaaca

SEQ ID NO: 42050 - RNA, 20 nt, Homo sapiens
ucugaaaacuacgaaacugg

SEQ ID NO: 42051 - RNA, 23 nt, Homo sapiens
ugaauggacuccucugaaaacua

SEQ ID NO: 42052 - RNA, 18 nt, Homo sapiens
cagcacuuugggaagcca

SEQ ID NO: 42053 - RNA, 22 nt, Homo sapiens
cgaaggaggaggacacacuuuu

SEQ ID NO: 42054 - RNA, 22 nt, Homo sapiens
gagccaagaucgugacacugca

SEQ ID NO: 42055 - RNA, 19 nt, Homo sapiens
uucucuacuaaaaauacaa

SEQ ID NO: 42056 - RNA, 17 nt, Homo sapiens
aacagucugcaagauuc

SEQ ID NO: 42057 - RNA, 23 nt, Homo sapiens
gucauagucacuauggugacuca

SEQ ID NO: 42058 - RNA, 19 nt, Homo sapiens
uccugaagccaucugugga

SEQ ID NO: 42059 - RNA, 21 nt, Homo sapiens
aaaacaaaaaccccacaaaac

SEQ ID NO: 42060 - RNA, 21 nt, Homo sapiens
cuguuucauugucacuauuga

SEQ ID NO: 42061 - RNA, 19 nt, Homo sapiens
uuuccuguuuucuucauuu

SEQ ID NO: 42062 - RNA, 21 nt, Homo sapiens
cacccugacucauuccgauua

SEQ ID NO: 42063 - RNA, 23 nt, Homo sapiens
gucaaagguugccagcgggcucu

SEQ ID NO: 42064 - RNA, 18 nt, Homo sapiens
uaagaaccuccucuccuc

SEQ ID NO: 42065 - RNA, 21 nt, Homo sapiens
ucucaccuccuucauccccua

SEQ ID NO: 42066 - RNA, 18 nt, Homo sapiens
uugcugugccucccacca

SEQ ID NO: 42067 - RNA, 23 nt, Homo sapiens
aaaggaucugcagaauuugucag

SEQ ID NO: 42068 - RNA, 22 nt, Homo sapiens
agaaugugcuuccaacuccauc

SEQ ID NO: 42069 - RNA, 26 nt, Homo sapiens
auuuggacuugccuuugucuugguuc

SEQ ID NO: 42070 - RNA, 21 nt, Homo sapiens
ccacauuuguguccucuuuua

SEQ ID NO: 42071 - RNA, 20 nt, Homo sapiens
ggacacagaguuugagcagc

SEQ ID NO: 42072 - RNA, 17 nt, Homo sapiens
ggggaguguugcgagug

SEQ ID NO: 42073 - RNA, 19 nt, Homo sapiens
ucuggaaaacuccugguuu

SEQ ID NO: 42074 - RNA, 23 nt, Homo sapiens
aaaggaucugcagaauuugucag

SEQ ID NO: 42075 - RNA, 22 nt, Homo sapiens
agaaugugcuuccaacuccauc

SEQ ID NO: 42076 - RNA, 26 nt, Homo sapiens
auuuggacuugccuuugucuugguuc

SEQ ID NO: 42077 - RNA, 21 nt, Homo sapiens
ccacauuuguguccucuuuua

SEQ ID NO: 42078 - RNA, 20 nt, Homo sapiens
ggacacagaguuugagcagc

SEQ ID NO: 42079 - RNA, 17 nt, Homo sapiens
ggggaguguugcgagug

SEQ ID NO: 42080 - RNA, 19 nt, Homo sapiens
ucuggaaaacuccugguuu

SEQ ID NO: 42081 - RNA, 21 nt, Homo sapiens
aaggaccguaagccccaugag

SEQ ID NO: 42082 - RNA, 20 nt, Homo sapiens
acaaagauccccuacugccu

SEQ ID NO: 42083 - RNA, 21 nt, Homo sapiens
accagagaauggaagccaggc

SEQ ID NO: 42084 - RNA, 19 nt, Homo sapiens
agggucagcagcucaguca

SEQ ID NO: 42085 - RNA, 20 nt, Homo sapiens
cacgcagcccaugcagugaa

SEQ ID NO: 42086 - RNA, 21 nt, Homo sapiens
cacugcagugcacgugugcca

SEQ ID NO: 42087 - RNA, 23 nt, Homo sapiens
caggaaagggccagcagccccaa

SEQ ID NO: 42088 - RNA, 21 nt, Homo sapiens
cagucccaccagaguggcuca

SEQ ID NO: 42089 - RNA, 25 nt, Homo sapiens
cccacccacagccagcucugccaga

SEQ ID NO: 42090 - RNA, 20 nt, Homo sapiens
cccugccagaggcccugugg

SEQ ID NO: 42091 - RNA, 20 nt, Homo sapiens
cgcacgcagcccaugcagug

SEQ ID NO: 42092 - RNA, 24 nt, Homo sapiens
gcaccagaggccuucgaagcccca

SEQ ID NO: 42093 - RNA, 21 nt, Homo sapiens
gcaucaacaccgccacccaca

SEQ ID NO: 42094 - RNA, 18 nt, Homo sapiens
gcccccaggagcuccacc

SEQ ID NO: 42095 - RNA, 19 nt, Homo sapiens
gccugcugaaagagccucc

SEQ ID NO: 42096 - RNA, 19 nt, Homo sapiens
gcgaccgcugggugccagg

SEQ ID NO: 42097 - RNA, 18 nt, Homo sapiens
gguccugggucugccaca

SEQ ID NO: 42098 - RNA, 20 nt, Homo sapiens
guccagcuccugggcccacc

SEQ ID NO: 42099 - RNA, 19 nt, Homo sapiens
guggugccgccuccugcca

SEQ ID NO: 42100 - RNA, 19 nt, Homo sapiens
ggcgguaccaggacagcuu

SEQ ID NO: 42101 - RNA, 20 nt, Homo sapiens
cugaaccaagagcacccacu

SEQ ID NO: 42102 - RNA, 19 nt, Homo sapiens
acauugggaauggccacaa

SEQ ID NO: 42103 - RNA, 24 nt, Homo sapiens
cuuugauggccaugacuucgugga

SEQ ID NO: 42104 - RNA, 17 nt, Homo sapiens
ggccaugacuucgugga

SEQ ID NO: 42105 - RNA, 26 nt, Homo sapiens
uaguuuuggugucccacaauuacuua

SEQ ID NO: 42106 - RNA, 18 nt, Homo sapiens
uggggaccccgcucacca

SEQ ID NO: 42107 - RNA, 20 nt, Homo sapiens
gcgcucacuggacacccucc

SEQ ID NO: 42108 - RNA, 18 nt, Homo sapiens
ucccucuggucacuguga

SEQ ID NO: 42109 - RNA, 17 nt, Homo sapiens
ggacagcaguaaccucu

SEQ ID NO: 42110 - RNA, 20 nt, Homo sapiens
gguuauuaacacugcuuuga

SEQ ID NO: 42111 - RNA, 21 nt, Homo sapiens
uuggaacagauuuuaucauca

SEQ ID NO: 42112 - RNA, 22 nt, Homo sapiens
uguaauugugucucguuugugu

SEQ ID NO: 42113 - RNA, 19 nt, Homo sapiens
ccuccagguacacuuggca

SEQ ID NO: 42114 - RNA, 18 nt, Homo sapiens
gacuucagcgagaaacug

SEQ ID NO: 42115 - RNA, 16 nt, Homo sapiens
ggcugcugcaccaucc

SEQ ID NO: 42116 - RNA, 20 nt, Homo sapiens
uuuuagaacucuucaucuua

SEQ ID NO: 42117 - RNA, 24 nt, Homo sapiens
ucaggugccccugaguccaccuua

SEQ ID NO: 42118 - RNA, 23 nt, Homo sapiens
aaauggaaaaagaugaagaauca

SEQ ID NO: 42119 - RNA, 22 nt, Homo sapiens
aagaaaggcaucauuuagguuc

SEQ ID NO: 42120 - RNA, 19 nt, Homo sapiens
aagagguuggugucaaugc

SEQ ID NO: 42121 - RNA, 22 nt, Homo sapiens
acaggugcuaacagggcacuga

SEQ ID NO: 42122 - RNA, 17 nt, Homo sapiens
acagucacaaaaacuuc

SEQ ID NO: 42123 - RNA, 18 nt, Homo sapiens
agagaaggacagaggugg

SEQ ID NO: 42124 - RNA, 23 nt, Homo sapiens
auuuauagccauccgaauccuga

SEQ ID NO: 42125 - RNA, 19 nt, Homo sapiens
auuuuccagagaacuuuca

SEQ ID NO: 42126 - RNA, 18 nt, Homo sapiens
caccccaucaccaacccu

SEQ ID NO: 42127 - RNA, 18 nt, Homo sapiens
cgcccucgaggugcacug

SEQ ID NO: 42128 - RNA, 16 nt, Homo sapiens
cugagcaaacucugua

SEQ ID NO: 42129 - RNA, 21 nt, Homo sapiens
gaagcagaagauacuacuuua

SEQ ID NO: 42130 - RNA, 21 nt, Homo sapiens
gaaucagacagcauucaccaa

SEQ ID NO: 42131 - RNA, 21 nt, Homo sapiens
gggcaauuuguccuuagugga

SEQ ID NO: 42132 - RNA, 19 nt, Homo sapiens
gggcacccagccuccccca

SEQ ID NO: 42133 - RNA, 23 nt, Homo sapiens
guucuggcccuagaccacgucca

SEQ ID NO: 42134 - RNA, 24 nt, Homo sapiens
uacaacuacuuuuacaacacucug

SEQ ID NO: 42135 - RNA, 25 nt, Homo sapiens
ucuuggugccgugaagaccugugag

SEQ ID NO: 42136 - RNA, 18 nt, Homo sapiens
ugacagagccaaguuggc

SEQ ID NO: 42137 - RNA, 24 nt, Homo sapiens
ugccuaccccaguuccuauccaca

SEQ ID NO: 42138 - RNA, 17 nt, Homo sapiens
uggagugaagucuguga

SEQ ID NO: 42139 - RNA, 23 nt, Homo sapiens
ugguucauucacgugugagacug

SEQ ID NO: 42140 - RNA, 18 nt, Homo sapiens
ugucuaaucaacauccua

SEQ ID NO: 42141 - RNA, 20 nt, Homo sapiens
uuauuacaacgaucuccugg

SEQ ID NO: 42142 - RNA, 21 nt, Homo sapiens
uucugcugggcaaagguuguc

SEQ ID NO: 42143 - RNA, 21 nt, Homo sapiens
uugucaaugucaucgacuuca

SEQ ID NO: 42144 - RNA, 16 nt, Homo sapiens
agaaaugggcagaucc

SEQ ID NO: 42145 - RNA, 17 nt, Homo sapiens
augugaaccugagcucc

SEQ ID NO: 42146 - RNA, 20 nt, Homo sapiens
caaggggacauggagaaagc

SEQ ID NO: 42147 - RNA, 21 nt, Homo sapiens
cgggguccaacgggggucugg

SEQ ID NO: 42148 - RNA, 17 nt, Homo sapiens
cuucccugcuucugccu

SEQ ID NO: 42149 - RNA, 21 nt, Homo sapiens
gacuuugccaacauggagcug

SEQ ID NO: 42150 - RNA, 24 nt, Homo sapiens
uggaugaauucaacaaugggguug

SEQ ID NO: 42151 - RNA, 20 nt, Homo sapiens
cuuugggacccagggccugc

SEQ ID NO: 42152 - RNA, 24 nt, Homo sapiens
cgccgggaccccaccucuaccucc

SEQ ID NO: 42153 - RNA, 24 nt, Homo sapiens
ccuuggccucucggaggccucugg

SEQ ID NO: 42154 - RNA, 20 nt, Homo sapiens
acagcagcagcccccgcuuc

SEQ ID NO: 42155 - RNA, 25 nt, Homo sapiens
ccugagcugccugccaccugccaga

SEQ ID NO: 42156 - RNA, 25 nt, Homo sapiens
ggcauccgccucagagcucccugga

SEQ ID NO: 42157 - RNA, 18 nt, Homo sapiens
cucagauguggcccugaa

SEQ ID NO: 42158 - RNA, 18 nt, Homo sapiens
uucugaccacaaugccag

SEQ ID NO: 42159 - RNA, 21 nt, Homo sapiens
aagcaaaacaaaacaauaaca

SEQ ID NO: 42160 - RNA, 20 nt, Homo sapiens
accaaggagggauuugggga

SEQ ID NO: 42161 - RNA, 19 nt, Homo sapiens
accccuuaugccugugacg

SEQ ID NO: 42162 - RNA, 23 nt, Homo sapiens
acccucagucucccugucugugg

SEQ ID NO: 42163 - RNA, 21 nt, Homo sapiens
acuuccaccuacagcuugcca

SEQ ID NO: 42164 - RNA, 19 nt, Homo sapiens
ccaaggagggauuugggga

SEQ ID NO: 42165 - RNA, 21 nt, Homo sapiens
gaaagagcuauuaccccuuuc

SEQ ID NO: 42166 - RNA, 18 nt, Homo sapiens
ugugacgguggcaagaaa

SEQ ID NO: 42167 - RNA, 18 nt, Homo sapiens
auccugaaacuaugacgg

SEQ ID NO: 42168 - RNA, 18 nt, Homo sapiens
ggagauggcgaggccugc

SEQ ID NO: 42169 - RNA, 23 nt, Homo sapiens
gugggacaucuuccuggauuuca

SEQ ID NO: 42170 - RNA, 21 nt, Homo sapiens
uacacccaagcacauccguca

SEQ ID NO: 42171 - RNA, 18 nt, Homo sapiens
agaagcccuguggcagcu

SEQ ID NO: 42172 - RNA, 18 nt, Homo sapiens
cgcggccccucgugcugc

SEQ ID NO: 42173 - RNA, 19 nt, Homo sapiens
agccacaggaaccgugagu

SEQ ID NO: 42174 - RNA, 18 nt, Homo sapiens
auccagcauccucaagug

SEQ ID NO: 42175 - RNA, 20 nt, Homo sapiens
cacugaggcccaggcuccca

SEQ ID NO: 42176 - RNA, 17 nt, Homo sapiens
cagaugcugaaccacua

SEQ ID NO: 42177 - RNA, 20 nt, Homo sapiens
ccgauguacacuucuccguc

SEQ ID NO: 42178 - RNA, 19 nt, Homo sapiens
cgccggcgccccugugcga

SEQ ID NO: 42179 - RNA, 16 nt, Homo sapiens
cggauccagaucugcc

SEQ ID NO: 42180 - RNA, 20 nt, Homo sapiens
cguguuggccuuuucugcug

SEQ ID NO: 42181 - RNA, 22 nt, Homo sapiens
gcaagaacagcuuugagcucua

SEQ ID NO: 42182 - RNA, 17 nt, Homo sapiens
gggaggaggccgggagc

SEQ ID NO: 42183 - RNA, 19 nt, Homo sapiens
uccagccccgcccacuucc

SEQ ID NO: 42184 - RNA, 21 nt, Homo sapiens
augucuuccaacaacuaccca

SEQ ID NO: 42185 - RNA, 20 nt, Homo sapiens
aauuuguuggguauacacug

SEQ ID NO: 42186 - RNA, 22 nt, Homo sapiens
caauuuuaaccuuuuucuggua

SEQ ID NO: 42187 - RNA, 18 nt, Homo sapiens
cuguaauaugcaauuuua

SEQ ID NO: 42188 - RNA, 23 nt, Homo sapiens
ucuauaaauauguaauaucauca

SEQ ID NO: 42189 - RNA, 18 nt, Homo sapiens
aacccggaaaaggaagcu

SEQ ID NO: 42190 - RNA, 17 nt, Homo sapiens
agaggcgucccgacucc

SEQ ID NO: 42191 - RNA, 20 nt, Homo sapiens
gccucucugagcccuggcuc

SEQ ID NO: 42192 - RNA, 23 nt, Homo sapiens
gcugauucaggagagccugcguu

SEQ ID NO: 42193 - RNA, 20 nt, Homo sapiens
uugaaacagcacaugaagaa

SEQ ID NO: 42194 - RNA, 18 nt, Homo sapiens
gagucaguuuugagcuuc

SEQ ID NO: 42195 - RNA, 20 nt, Homo sapiens
gcagagucaguuuugagcuu

SEQ ID NO: 42196 - RNA, 21 nt, Homo sapiens
uccagggcagaccuagacuca

SEQ ID NO: 42197 - RNA, 19 nt, Homo sapiens
gcggaccgcccucgccucc

SEQ ID NO: 42198 - RNA, 21 nt, Homo sapiens
cccuggcagggggcuucugga

SEQ ID NO: 42199 - RNA, 17 nt, Homo sapiens
cgggcaccacgagcuca

SEQ ID NO: 42200 - RNA, 18 nt, Homo sapiens
ccuggccccacccagcuc

SEQ ID NO: 42201 - RNA, 18 nt, Homo sapiens
gagaaggaagaaagguga

SEQ ID NO: 42202 - RNA, 21 nt, Homo sapiens
uccccaaggggccccuugaca

SEQ ID NO: 42203 - RNA, 21 nt, Homo sapiens
aacugacagcaagggcacuga

SEQ ID NO: 42204 - RNA, 22 nt, Homo sapiens
accugggcccagcgucaggcuu

SEQ ID NO: 42205 - RNA, 21 nt, Homo sapiens
ugguccucgucaucuguggac

SEQ ID NO: 42206 - RNA, 18 nt, Homo sapiens
agagagagacccagcauc

SEQ ID NO: 42207 - RNA, 23 nt, Homo sapiens
ucaauuucccucccaucaccuca

SEQ ID NO: 42208 - RNA, 19 nt, Homo sapiens
uccagcacucaugaugcca

SEQ ID NO: 42209 - RNA, 19 nt, Homo sapiens
gggagcccgccccgcuucc

SEQ ID NO: 42210 - RNA, 20 nt, Homo sapiens
ccucuuuguggccuggaccu

SEQ ID NO: 42211 - RNA, 16 nt, Homo sapiens
aacucucccuucuccu

SEQ ID NO: 42212 - RNA, 19 nt, Homo sapiens
auggagcagaucugugaca

SEQ ID NO: 42213 - RNA, 21 nt, Homo sapiens
caccacacccggccccccuuc

SEQ ID NO: 42214 - RNA, 20 nt, Homo sapiens
ccucugccucccagguucaa

SEQ ID NO: 42215 - RNA, 19 nt, Homo sapiens
cugcaaccucugccuccca

SEQ ID NO: 42216 - RNA, 21 nt, Homo sapiens
cuggugacauggagcagaucu

SEQ ID NO: 42217 - RNA, 19 nt, Homo sapiens
ggaacuuaacuuggggcua

SEQ ID NO: 42218 - RNA, 17 nt, Homo sapiens
uaccccacccuacccca

SEQ ID NO: 42219 - RNA, 16 nt, Homo sapiens
aacucucccuucuccu

SEQ ID NO: 42220 - RNA, 21 nt, Homo sapiens
caccacacccggccccccuuc

SEQ ID NO: 42221 - RNA, 20 nt, Homo sapiens
ccucugccucccagguucaa

SEQ ID NO: 42222 - RNA, 19 nt, Homo sapiens
cugcaaccucugccuccca

SEQ ID NO: 42223 - RNA, 21 nt, Homo sapiens
cuggugacauggagcagaucu

SEQ ID NO: 42224 - RNA, 22 nt, Homo sapiens
gagccaagauugcaccacugca

SEQ ID NO: 42225 - RNA, 22 nt, Homo sapiens
gcccccaucccacccuacccca

SEQ ID NO: 42226 - RNA, 19 nt, Homo sapiens
ggaacuuaacuuggggcua

SEQ ID NO: 42227 - RNA, 17 nt, Homo sapiens
uaccccacccuacccca

SEQ ID NO: 42228 - RNA, 19 nt, Homo sapiens
aggggccacacuggaccau

SEQ ID NO: 42229 - RNA, 20 nt, Homo sapiens
ccccgcccuauccccuacgc

SEQ ID NO: 42230 - RNA, 22 nt, Homo sapiens
cucguggcccugcucugccucu

SEQ ID NO: 42231 - RNA, 19 nt, Homo sapiens
guucaggcugcuucggugu

SEQ ID NO: 42232 - RNA, 19 nt, Homo sapiens
acccaccugcuccgcggcg

SEQ ID NO: 42233 - RNA, 21 nt, Homo sapiens
cgcacacucccaguuguucac

SEQ ID NO: 42234 - RNA, 19 nt, Homo sapiens
cgcacgcuacaaacacaca

SEQ ID NO: 42235 - RNA, 19 nt, Homo sapiens
cuuucucucucucucucuc

SEQ ID NO: 42236 - RNA, 19 nt, Homo sapiens
aaacuccugaccucaggug

SEQ ID NO: 42237 - RNA, 19 nt, Homo sapiens
acaaggacauucacugcug

SEQ ID NO: 42238 - RNA, 18 nt, Homo sapiens
agaggugucaugcuuugg

SEQ ID NO: 42239 - RNA, 21 nt, Homo sapiens
aucuuggcucacugcaaccuc

SEQ ID NO: 42240 - RNA, 21 nt, Homo sapiens
ccacugcaccugaccugcuga

SEQ ID NO: 42241 - RNA, 23 nt, Homo sapiens
cugaacccugcuccguuggucag

SEQ ID NO: 42242 - RNA, 19 nt, Homo sapiens
cugcaaccuccgccucuca

SEQ ID NO: 42243 - RNA, 18 nt, Homo sapiens
cugggauuacaggcaccu

SEQ ID NO: 42244 - RNA, 16 nt, Homo sapiens
gaaccacgugaaacug

SEQ ID NO: 42245 - RNA, 19 nt, Homo sapiens
gaauucuucuguucucugg

SEQ ID NO: 42246 - RNA, 18 nt, Homo sapiens
uccgccucucagguucaa

SEQ ID NO: 42247 - RNA, 19 nt, Homo sapiens
caggccucuggcgccccca

SEQ ID NO: 42248 - RNA, 18 nt, Homo sapiens
uccgacuccuggguucaa

SEQ ID NO: 42249 - RNA, 21 nt, Homo sapiens
aacaaaaacagcaguuuguga

SEQ ID NO: 42250 - RNA, 16 nt, Homo sapiens
agccuguaaacggugc

SEQ ID NO: 42251 - RNA, 18 nt, Homo sapiens
caauuuggaaggcauuga

SEQ ID NO: 42252 - RNA, 20 nt, Homo sapiens
ccauggauacgcuugugauc

SEQ ID NO: 42253 - RNA, 22 nt, Homo sapiens
guuucuccauuaauaguaacuc

SEQ ID NO: 42254 - RNA, 18 nt, Homo sapiens
auaauacaccuggaaguu

SEQ ID NO: 42255 - RNA, 21 nt, Homo sapiens
auuagcauuaaaauagcuaaa

SEQ ID NO: 42256 - RNA, 22 nt, Homo sapiens
uagauggauguauacgaagcug

SEQ ID NO: 42257 - RNA, 22 nt, Homo sapiens
ugcaaagauggaaaagcuucuu

SEQ ID NO: 42258 - RNA, 24 nt, Homo sapiens
gacaaucagaauuccacugcccaa

SEQ ID NO: 42259 - RNA, 21 nt, Homo sapiens
uaaagaaucaaagucauuuuu

SEQ ID NO: 42260 - RNA, 23 nt, Homo sapiens
ugguuacgguggagacauugaca

SEQ ID NO: 42261 - RNA, 22 nt, Homo sapiens
acucgucaauacuccugugauc

SEQ ID NO: 42262 - RNA, 19 nt, Homo sapiens
auguggacuggacacucca

SEQ ID NO: 42263 - RNA, 22 nt, Homo sapiens
uaaccaaguaaauguuuucuau

SEQ ID NO: 42264 - RNA, 17 nt, Homo sapiens
uuccagaggugacauuc

SEQ ID NO: 42265 - RNA, 21 nt, Homo sapiens
accaaagccaaucugcucuag

SEQ ID NO: 42266 - RNA, 21 nt, Homo sapiens
caccauuacccacccccguuc

SEQ ID NO: 42267 - RNA, 18 nt, Homo sapiens
cagggugugcacccucuc

SEQ ID NO: 42268 - RNA, 20 nt, Homo sapiens
ccaauggcaucucuccaucu

SEQ ID NO: 42269 - RNA, 20 nt, Homo sapiens
cccacuacugcuuucccugu

SEQ ID NO: 42270 - RNA, 24 nt, Homo sapiens
gcugagcaaacucauauuccaguu

SEQ ID NO: 42271 - RNA, 17 nt, Homo sapiens
ucucuucaucaccaggu

SEQ ID NO: 42272 - RNA, 21 nt, Homo sapiens
ucuguauugauugugucuuuu

SEQ ID NO: 42273 - RNA, 18 nt, Homo sapiens
gucugaaccgauauuucu

SEQ ID NO: 42274 - RNA, 19 nt, Homo sapiens
ugugcuggaguugucugaa

SEQ ID NO: 42275 - RNA, 20 nt, Homo sapiens
aagaccugaaaauaugucug

SEQ ID NO: 42276 - RNA, 27 nt, Homo sapiens
uaaaaaagugaucuuagguuuguuuuu

SEQ ID NO: 42277 - RNA, 19 nt, Homo sapiens
ucauuugcaauucauguaa

SEQ ID NO: 42278 - RNA, 18 nt, Homo sapiens
uuucuccucugcuaugca

SEQ ID NO: 42279 - RNA, 23 nt, Homo sapiens
aaauaauuuugucccaagucuua

SEQ ID NO: 42280 - RNA, 18 nt, Homo sapiens
caugcuuugcacucuccu

SEQ ID NO: 42281 - RNA, 21 nt, Homo sapiens
ggcaaagaugaaaacuuccca

SEQ ID NO: 42282 - RNA, 19 nt, Homo sapiens
caaggccagaaccagcagg

SEQ ID NO: 42283 - RNA, 16 nt, Homo sapiens
gcacauccuugcugcu

SEQ ID NO: 42284 - RNA, 25 nt, Homo sapiens
gggcuauuauagaugaaaacugcac

SEQ ID NO: 42285 - RNA, 23 nt, Homo sapiens
gguagauggggagggucugugug

SEQ ID NO: 42286 - RNA, 22 nt, Homo sapiens
aggccugcgccggcauccuccg

SEQ ID NO: 42287 - RNA, 19 nt, Homo sapiens
cuuugaugguugccugcuu

SEQ ID NO: 42288 - RNA, 19 nt, Homo sapiens
cgcccgcagcccugccucc

SEQ ID NO: 42289 - RNA, 18 nt, Homo sapiens
gagguggucaugcccggg

SEQ ID NO: 42290 - RNA, 17 nt, Homo sapiens
ugcaaaucaacauucca

SEQ ID NO: 42291 - RNA, 18 nt, Homo sapiens
acugcaguucuccucuga

SEQ ID NO: 42292 - RNA, 20 nt, Homo sapiens
agcaccucuucaccuugcuc

SEQ ID NO: 42293 - RNA, 22 nt, Homo sapiens
aucuccaaguuucugggcgcca

SEQ ID NO: 42294 - RNA, 22 nt, Homo sapiens
cccagaccuaggagcuccccaa

SEQ ID NO: 42295 - RNA, 18 nt, Homo sapiens
ucauucuuccuggacuca

SEQ ID NO: 42296 - RNA, 18 nt, Homo sapiens
ucccaggcacagcugcag

SEQ ID NO: 42297 - RNA, 20 nt, Homo sapiens
gccaguggggauccuggggg

SEQ ID NO: 42298 - RNA, 17 nt, Homo sapiens
aaacaggcucgcugcag

SEQ ID NO: 42299 - RNA, 18 nt, Homo sapiens
cagggcauuuuccgcaac

SEQ ID NO: 42300 - RNA, 20 nt, Homo sapiens
ccaccuccacucccgccucc

SEQ ID NO: 42301 - RNA, 16 nt, Homo sapiens
cccagagaacuguucc

SEQ ID NO: 42302 - RNA, 19 nt, Homo sapiens
ucugagccaggacuuggag

SEQ ID NO: 42303 - RNA, 21 nt, Homo sapiens
ugcacaggcucccugcugccc

SEQ ID NO: 42304 - RNA, 21 nt, Homo sapiens
caccaccaccuuuuuucuuuu

SEQ ID NO: 42305 - RNA, 20 nt, Homo sapiens
gucuaccagaugucuuuuga

SEQ ID NO: 42306 - RNA, 21 nt, Homo sapiens
guguguauguccugcuucauu

SEQ ID NO: 42307 - RNA, 18 nt, Homo sapiens
uugagaccagccuggccc

SEQ ID NO: 42308 - RNA, 21 nt, Homo sapiens
uuucuucauuacacuaaccuu

SEQ ID NO: 42309 - RNA, 18 nt, Homo sapiens
ccacacaagcaagccaaa

SEQ ID NO: 42310 - RNA, 23 nt, Homo sapiens
ccucuuacugugccuuuagccuu

SEQ ID NO: 42311 - RNA, 21 nt, Homo sapiens
guggcagauuguacacugcua

SEQ ID NO: 42312 - RNA, 21 nt, Homo sapiens
uucugucucaaaacacuuuga

SEQ ID NO: 42313 - RNA, 21 nt, Homo sapiens
uuguuaaagauuuauuuuuac

SEQ ID NO: 42314 - RNA, 21 nt, Homo sapiens
aaacccuacaaaacaaaaaca

SEQ ID NO: 42315 - RNA, 18 nt, Homo sapiens
cgaaugguguuuaaagac

SEQ ID NO: 42316 - RNA, 23 nt, Homo sapiens
gccucucccucucccuccccccu

SEQ ID NO: 42317 - RNA, 23 nt, Homo sapiens
caggcucgggggagccuccucca

SEQ ID NO: 42318 - RNA, 18 nt, Homo sapiens
ugucagguggugagcucu

SEQ ID NO: 42319 - RNA, 18 nt, Homo sapiens
uuuauggauucuccgcac

SEQ ID NO: 42320 - RNA, 17 nt, Homo sapiens
aggaguuacacagaucu

SEQ ID NO: 42321 - RNA, 21 nt, Homo sapiens
ccaggaguuacacagaucuca

SEQ ID NO: 42322 - RNA, 18 nt, Homo sapiens
ugugggaauugauacaca

SEQ ID NO: 42323 - RNA, 18 nt, Homo sapiens
uugagaucaccaggccuc

SEQ ID NO: 42324 - RNA, 15 nt, Homo sapiens
ggcgacggcggcggc

SEQ ID NO: 42325 - RNA, 18 nt, Homo sapiens
cuguggacugucugacuc

SEQ ID NO: 42326 - RNA, 15 nt, Homo sapiens
cuuuuguucuggugu

SEQ ID NO: 42327 - RNA, 22 nt, Homo sapiens
acuguaaaugauguguacaaca

SEQ ID NO: 42328 - RNA, 19 nt, Homo sapiens
uaagaaaaaauuggaaauc

SEQ ID NO: 42329 - RNA, 19 nt, Homo sapiens
ugaccaccaaaagcaguca

SEQ ID NO: 42330 - RNA, 22 nt, Homo sapiens
acuucuccuuuguauucucuca

SEQ ID NO: 42331 - RNA, 21 nt, Homo sapiens
agucucacucugucgccaggc

SEQ ID NO: 42332 - RNA, 18 nt, Homo sapiens
aucccauuaaaugaggaa

SEQ ID NO: 42333 - RNA, 22 nt, Homo sapiens
aucuuggcucacugcaaccucu

SEQ ID NO: 42334 - RNA, 20 nt, Homo sapiens
ccucugccuccuggguucaa

SEQ ID NO: 42335 - RNA, 21 nt, Homo sapiens
ccugagcaaaaagauacuuuu

SEQ ID NO: 42336 - RNA, 21 nt, Homo sapiens
gacaggaaacaucccauucca

SEQ ID NO: 42337 - RNA, 17 nt, Homo sapiens
ucaagcgauucuugugc

SEQ ID NO: 42338 - RNA, 21 nt, Homo sapiens
uuucacuuguauuguuuuuca

SEQ ID NO: 42339 - RNA, 18 nt, Homo sapiens
cauguaucaguccucuga

SEQ ID NO: 42340 - RNA, 23 nt, Homo sapiens
ucaacaaaaaguaagcuguacua

SEQ ID NO: 42341 - RNA, 20 nt, Homo sapiens
ugccaugguauaugugggug

SEQ ID NO: 42342 - RNA, 18 nt, Homo sapiens
ugggaauuuugcaauuug

SEQ ID NO: 42343 - RNA, 18 nt, Homo sapiens
uucagagugacugcucca

SEQ ID NO: 42344 - RNA, 18 nt, Homo sapiens
cuugucaguuuucucuca

SEQ ID NO: 42345 - RNA, 19 nt, Homo sapiens
gaaaaagggcugcccaugu

SEQ ID NO: 42346 - RNA, 20 nt, Homo sapiens
ggccucaaugguugcagcaa

SEQ ID NO: 42347 - RNA, 18 nt, Homo sapiens
aacauccagacgauuuca

SEQ ID NO: 42348 - RNA, 17 nt, Homo sapiens
agacauccuccaccaua

SEQ ID NO: 42349 - RNA, 18 nt, Homo sapiens
agcaucugcccuggaaau

SEQ ID NO: 42350 - RNA, 18 nt, Homo sapiens
cacuuucacaccacuugg

SEQ ID NO: 42351 - RNA, 18 nt, Homo sapiens
cauccacacauuugcacc

SEQ ID NO: 42352 - RNA, 18 nt, Homo sapiens
ccuggcggugagcgcgga

SEQ ID NO: 42353 - RNA, 25 nt, Homo sapiens
ccuuugagcuaaugacugucuccag

SEQ ID NO: 42354 - RNA, 23 nt, Homo sapiens
cuaaugcaaggagggcuaguuca

SEQ ID NO: 42355 - RNA, 21 nt, Homo sapiens
cuggcaggcugaccauuacca

SEQ ID NO: 42356 - RNA, 16 nt, Homo sapiens
ucagcuguaaccacag

SEQ ID NO: 42357 - RNA, 17 nt, Homo sapiens
augaacgaauucaugcc

SEQ ID NO: 42358 - RNA, 18 nt, Homo sapiens
ccugcaggauuccaucca

SEQ ID NO: 42359 - RNA, 18 nt, Homo sapiens
gcugcaacaacugcugca

SEQ ID NO: 42360 - RNA, 19 nt, Homo sapiens
ucugagcagguucuggccc

SEQ ID NO: 42361 - RNA, 19 nt, Homo sapiens
ucuggugaggagcugcgaa

SEQ ID NO: 42362 - RNA, 22 nt, Homo sapiens
ugccuucaguuccucccaccuc

SEQ ID NO: 42363 - RNA, 17 nt, Homo sapiens
ccauggaacccuuguuu

SEQ ID NO: 42364 - RNA, 18 nt, Homo sapiens
guauacuaaaagccuuaa

SEQ ID NO: 42365 - RNA, 17 nt, Homo sapiens
ucaagugauucuccugc

SEQ ID NO: 42366 - RNA, 18 nt, Homo sapiens
uccgccucccggguucaa

SEQ ID NO: 42367 - RNA, 22 nt, Homo sapiens
uugcugcugaaagaugucugug

SEQ ID NO: 42368 - RNA, 17 nt, Homo sapiens
aaacgcaaagguuugca

SEQ ID NO: 42369 - RNA, 20 nt, Homo sapiens
cucaaaaacgcaaagguuug

SEQ ID NO: 42370 - RNA, 20 nt, Homo sapiens
aguuaaugugcuuucuugga

SEQ ID NO: 42371 - RNA, 19 nt, Homo sapiens
aguuggaagucaucagcca

SEQ ID NO: 42372 - RNA, 23 nt, Homo sapiens
gaaagccacagagaaaucuccca

SEQ ID NO: 42373 - RNA, 18 nt, Homo sapiens
uuuuucaggcuuuagcuu

SEQ ID NO: 42374 - RNA, 22 nt, Homo sapiens
gcuccucccagcucuggccccu

SEQ ID NO: 42375 - RNA, 24 nt, Homo sapiens
ggaagaagagcagugggauugcca

SEQ ID NO: 42376 - RNA, 18 nt, Homo sapiens
ugaaguugcuucugugga

SEQ ID NO: 42377 - RNA, 19 nt, Homo sapiens
uggaacugauuugaggcua

SEQ ID NO: 42378 - RNA, 20 nt, Homo sapiens
ccuaguuggaaacuugugga

SEQ ID NO: 42379 - RNA, 18 nt, Homo sapiens
ccugaaugacaauggagu

SEQ ID NO: 42380 - RNA, 21 nt, Homo sapiens
ccagucgcgucccacuugaca

SEQ ID NO: 42381 - RNA, 21 nt, Homo sapiens
guuuucuugcuccuguggaug

SEQ ID NO: 42382 - RNA, 21 nt, Homo sapiens
uaaaccaggggcacaaugcac

SEQ ID NO: 42383 - RNA, 18 nt, Homo sapiens
uguuggcaguagugcugc

SEQ ID NO: 42384 - RNA, 18 nt, Homo sapiens
acccaccucguuuccgca

SEQ ID NO: 42385 - RNA, 16 nt, Homo sapiens
auguuggggugcagcc

SEQ ID NO: 42386 - RNA, 18 nt, Homo sapiens
cacacucaccuccaccuu

SEQ ID NO: 42387 - RNA, 17 nt, Homo sapiens
ccauucucuggacuuca

SEQ ID NO: 42388 - RNA, 17 nt, Homo sapiens
ccccaccaugccccgca

SEQ ID NO: 42389 - RNA, 22 nt, Homo sapiens
cgcccgccccccacccgcucca

SEQ ID NO: 42390 - RNA, 18 nt, Homo sapiens
cucucucccucaugaaca

SEQ ID NO: 42391 - RNA, 22 nt, Homo sapiens
guucaaggccaucgggagcucu

SEQ ID NO: 42392 - RNA, 20 nt, Homo sapiens
aaaccaauggaggacucagg

SEQ ID NO: 42393 - RNA, 18 nt, Homo sapiens
ccaucaaaccaauggagg

SEQ ID NO: 42394 - RNA, 21 nt, Homo sapiens
cccugcuugagaagguuuugg

SEQ ID NO: 42395 - RNA, 21 nt, Homo sapiens
cuguccugcuuuugcuuccca

SEQ ID NO: 42396 - RNA, 20 nt, Homo sapiens
gcuggggcccaggaagagua

SEQ ID NO: 42397 - RNA, 20 nt, Homo sapiens
acacaccaaagucucugcca

SEQ ID NO: 42398 - RNA, 23 nt, Homo sapiens
agaaggugcaguauuacacauca

SEQ ID NO: 42399 - RNA, 20 nt, Homo sapiens
cucagauuuuagaggcuuuu

SEQ ID NO: 42400 - RNA, 18 nt, Homo sapiens
gccuagcagucuacuuca

SEQ ID NO: 42401 - RNA, 19 nt, Homo sapiens
uaucacccggaaaaccuca

SEQ ID NO: 42402 - RNA, 22 nt, Homo sapiens
uuuagcauauugaaacauuaga

SEQ ID NO: 42403 - RNA, 24 nt, Homo sapiens
uuuccccaugccauccacaguguu

SEQ ID NO: 42404 - RNA, 20 nt, Homo sapiens
augucuaauaaccagacuuc

SEQ ID NO: 42405 - RNA, 22 nt, Homo sapiens
ccacuggcucauuaugagucau

SEQ ID NO: 42406 - RNA, 21 nt, Homo sapiens
cucuuucaccuugaacuugua

SEQ ID NO: 42407 - RNA, 24 nt, Homo sapiens
ucauuuuccuuuagcuucugcuca

SEQ ID NO: 42408 - RNA, 20 nt, Homo sapiens
uuauacauuccaggaguagc

SEQ ID NO: 42409 - RNA, 22 nt, Homo sapiens
gcgguuuuuuugguuuguuguu

SEQ ID NO: 42410 - RNA, 22 nt, Homo sapiens
gguauccuagguaagagccccu

SEQ ID NO: 42411 - RNA, 18 nt, Homo sapiens
uccaccucccggguucaa

SEQ ID NO: 42412 - RNA, 20 nt, Homo sapiens
uggccaggcuggucuugaac

SEQ ID NO: 42413 - RNA, 19 nt, Homo sapiens
agccacuggucaggaccac

SEQ ID NO: 42414 - RNA, 19 nt, Homo sapiens
aggauuuggguccugguga

SEQ ID NO: 42415 - RNA, 20 nt, Homo sapiens
cacaucccccacaggugcug

SEQ ID NO: 42416 - RNA, 24 nt, Homo sapiens
ggagcuggucuggggagcauugac

SEQ ID NO: 42417 - RNA, 18 nt, Homo sapiens
gacccgaguccucacuca

SEQ ID NO: 42418 - RNA, 22 nt, Homo sapiens
uggcugcccuccccacaggggg

SEQ ID NO: 42419 - RNA, 21 nt, Homo sapiens
uucuggcgguggggaaacggc

SEQ ID NO: 42420 - RNA, 19 nt, Homo sapiens
caucccuguaauuccagca

SEQ ID NO: 42421 - RNA, 22 nt, Homo sapiens
gagccaagauugugccacugca

SEQ ID NO: 42422 - RNA, 24 nt, Homo sapiens
uaaauaugacucuaguguaaauua

SEQ ID NO: 42423 - RNA, 27 nt, Homo sapiens
uuuuugugugugugcgugggguuugug

SEQ ID NO: 42424 - RNA, 20 nt, Homo sapiens
aagacaccugucaaauguca

SEQ ID NO: 42425 - RNA, 19 nt, Homo sapiens
aagaccuaucaugccaaga

SEQ ID NO: 42426 - RNA, 16 nt, Homo sapiens
acaucacagggcaagc

SEQ ID NO: 42427 - RNA, 22 nt, Homo sapiens
acucgccucugcuccugugguc

SEQ ID NO: 42428 - RNA, 18 nt, Homo sapiens
cacucuccagccauuugg

SEQ ID NO: 42429 - RNA, 17 nt, Homo sapiens
cccccugggauggcuca

SEQ ID NO: 42430 - RNA, 18 nt, Homo sapiens
ccgggugggggauuuugg

SEQ ID NO: 42431 - RNA, 24 nt, Homo sapiens
gcaggcaucaaacuuuacauccca

SEQ ID NO: 42432 - RNA, 17 nt, Homo sapiens
ugccaccaccaagccca

SEQ ID NO: 42433 - RNA, 20 nt, Homo sapiens
aagacaccugucaaauguca

SEQ ID NO: 42434 - RNA, 19 nt, Homo sapiens
aagaccuaucaugccaaga

SEQ ID NO: 42435 - RNA, 16 nt, Homo sapiens
acaucacagggcaagc

SEQ ID NO: 42436 - RNA, 22 nt, Homo sapiens
acucgccucugcuccugugguc

SEQ ID NO: 42437 - RNA, 18 nt, Homo sapiens
cacucuccagccauuugg

SEQ ID NO: 42438 - RNA, 17 nt, Homo sapiens
cccccugggauggcuca

SEQ ID NO: 42439 - RNA, 18 nt, Homo sapiens
ccgggugggggauuuugg

SEQ ID NO: 42440 - RNA, 24 nt, Homo sapiens
gcaggcaucaaacuuuacauccca

SEQ ID NO: 42441 - RNA, 17 nt, Homo sapiens
ugccaccaccaagccca

SEQ ID NO: 42442 - RNA, 21 nt, Homo sapiens
acccaccgcccaggcucaucu

SEQ ID NO: 42443 - RNA, 20 nt, Homo sapiens
auggauacaauagaaaugua

SEQ ID NO: 42444 - RNA, 21 nt, Homo sapiens
gccuggccugagucaccagug

SEQ ID NO: 42445 - RNA, 19 nt, Homo sapiens
caaauuaaacucaaucucu

SEQ ID NO: 42446 - RNA, 21 nt, Homo sapiens
ccuuuucauaaacucugguuu

SEQ ID NO: 42447 - RNA, 18 nt, Homo sapiens
gaacaaucagauuuaaac

SEQ ID NO: 42448 - RNA, 17 nt, Homo sapiens
gacuguaucuuauuuug

SEQ ID NO: 42449 - RNA, 16 nt, Homo sapiens
ugcagaaaccaugcaa

SEQ ID NO: 42450 - RNA, 19 nt, Homo sapiens
uuuguuuaaaggccuggcu

SEQ ID NO: 42451 - RNA, 20 nt, Homo sapiens
aagacaccugucaaauguca

SEQ ID NO: 42452 - RNA, 19 nt, Homo sapiens
aagaccuaucaugccaaga

SEQ ID NO: 42453 - RNA, 16 nt, Homo sapiens
acaucacagggcaagc

SEQ ID NO: 42454 - RNA, 22 nt, Homo sapiens
acucgccucugcuccugugguc

SEQ ID NO: 42455 - RNA, 18 nt, Homo sapiens
cacucuccagccauuugg

SEQ ID NO: 42456 - RNA, 17 nt, Homo sapiens
cccccugggauggcuca

SEQ ID NO: 42457 - RNA, 18 nt, Homo sapiens
ccgggugggggauuuugg

SEQ ID NO: 42458 - RNA, 24 nt, Homo sapiens
gcaggcaucaaacuuuacauccca

SEQ ID NO: 42459 - RNA, 17 nt, Homo sapiens
ugccaccaccaagccca

SEQ ID NO: 42460 - RNA, 18 nt, Homo sapiens
agacgcccucugaagcca

SEQ ID NO: 42461 - RNA, 17 nt, Homo sapiens
caagaaaucuuguguca

SEQ ID NO: 42462 - RNA, 22 nt, Homo sapiens
gaucugaugaaaauacaaccuc

SEQ ID NO: 42463 - RNA, 19 nt, Homo sapiens
gcuuccuaccugacauguu

SEQ ID NO: 42464 - RNA, 19 nt, Homo sapiens
ggccgggugcgguggcuca

SEQ ID NO: 42465 - RNA, 22 nt, Homo sapiens
ucuggaaaacaacacacgguga

SEQ ID NO: 42466 - RNA, 20 nt, Homo sapiens
uggguggaucucccagaaau

SEQ ID NO: 42467 - RNA, 19 nt, Homo sapiens
gcgucugcaccacacauuc

SEQ ID NO: 42468 - RNA, 18 nt, Homo sapiens
ucaguccugcgucugcac

SEQ ID NO: 42469 - RNA, 18 nt, Homo sapiens
ucugcaccacacauucaa

SEQ ID NO: 42470 - RNA, 18 nt, Homo sapiens
aaugaagucucuuucccc

SEQ ID NO: 42471 - RNA, 21 nt, Homo sapiens
accagaagaaccacucaagca

SEQ ID NO: 42472 - RNA, 18 nt, Homo sapiens
uuccauuccgcggagcug

SEQ ID NO: 42473 - RNA, 22 nt, Homo sapiens
aaaguuuaguuuuucccauucg

SEQ ID NO: 42474 - RNA, 21 nt, Homo sapiens
aaguuuaguuuuucccauucg

SEQ ID NO: 42475 - RNA, 23 nt, Homo sapiens
acuucucuucauuacugauagua

SEQ ID NO: 42476 - RNA, 17 nt, Homo sapiens
ccugggcaguuuuauuc

SEQ ID NO: 42477 - RNA, 17 nt, Homo sapiens
cuuggcaccagcaccca

SEQ ID NO: 42478 - RNA, 24 nt, Homo sapiens
uuuuuuccugguuuguuugaucuu

SEQ ID NO: 42479 - RNA, 23 nt, Homo sapiens
ccagcaucucauuuucccccaua

SEQ ID NO: 42480 - RNA, 18 nt, Homo sapiens
cuaugaccucguguccuc

SEQ ID NO: 42481 - RNA, 19 nt, Homo sapiens
cuagaagguaugugugauu

SEQ ID NO: 42482 - RNA, 24 nt, Homo sapiens
uccagggcuccaagcugagucuga

SEQ ID NO: 42483 - RNA, 20 nt, Homo sapiens
uuccagagggagcccuccag

SEQ ID NO: 42484 - RNA, 18 nt, Homo sapiens
uuccaggggucugcccag

SEQ ID NO: 42485 - RNA, 23 nt, Homo sapiens
aagugguggcggggggccugugg

SEQ ID NO: 42486 - RNA, 18 nt, Homo sapiens
cacugccuaccuccugcc

SEQ ID NO: 42487 - RNA, 21 nt, Homo sapiens
gaacugagcaccugcacugca

SEQ ID NO: 42488 - RNA, 20 nt, Homo sapiens
ggggcugucccagcccaaga

SEQ ID NO: 42489 - RNA, 19 nt, Homo sapiens
ucagcaggguggcugauga

SEQ ID NO: 42490 - RNA, 20 nt, Homo sapiens
uggauggcggcagcguggag

SEQ ID NO: 42491 - RNA, 19 nt, Homo sapiens
acccccgguauccccccca

SEQ ID NO: 42492 - RNA, 18 nt, Homo sapiens
accucagcuuuguuguca

SEQ ID NO: 42493 - RNA, 17 nt, Homo sapiens
accuggacccacauuug

SEQ ID NO: 42494 - RNA, 21 nt, Homo sapiens
aucucggcucacugcaaucuc

SEQ ID NO: 42495 - RNA, 18 nt, Homo sapiens
cccccgccucguccucca

SEQ ID NO: 42496 - RNA, 24 nt, Homo sapiens
ccuuuuuauggcugagcaguaucu

SEQ ID NO: 42497 - RNA, 19 nt, Homo sapiens
cugcaaucuccgccuccca

SEQ ID NO: 42498 - RNA, 17 nt, Homo sapiens
gcacgccaccacuuccu

SEQ ID NO: 42499 - RNA, 21 nt, Homo sapiens
ggagauggagccgggugcggc

SEQ ID NO: 42500 - RNA, 18 nt, Homo sapiens
uccgccucccagguucaa

SEQ ID NO: 42501 - RNA, 22 nt, Homo sapiens
ucuggugccaccugagcacuca

SEQ ID NO: 42502 - RNA, 27 nt, Homo sapiens
uggauggauuugccgauucugaaauug

SEQ ID NO: 42503 - RNA, 19 nt, Homo sapiens
cugagcggcugccgggccc

SEQ ID NO: 42504 - RNA, 21 nt, Homo sapiens
gccugagccggcccccggucc

SEQ ID NO: 42505 - RNA, 19 nt, Homo sapiens
acagaagucugaccucucu

SEQ ID NO: 42506 - RNA, 23 nt, Homo sapiens
caaauaaugaucauacaucuuca

SEQ ID NO: 42507 - RNA, 22 nt, Homo sapiens
cagcuagcccacacagacccca

SEQ ID NO: 42508 - RNA, 23 nt, Homo sapiens
gaaaaaaauccaaauggacauca

SEQ ID NO: 42509 - RNA, 22 nt, Homo sapiens
gaacaucgccaauaaugggaca

SEQ ID NO: 42510 - RNA, 20 nt, Homo sapiens
gcucagcuggaagcuuuuga

SEQ ID NO: 42511 - RNA, 21 nt, Homo sapiens
ugcaggagugguccaggcagg

SEQ ID NO: 42512 - RNA, 17 nt, Homo sapiens
uggacaucaacagcuuu

SEQ ID NO: 42513 - RNA, 21 nt, Homo sapiens
caccuucauagucacauucga

SEQ ID NO: 42514 - RNA, 17 nt, Homo sapiens
cgccaccgucugucuca

SEQ ID NO: 42515 - RNA, 17 nt, Homo sapiens
gucuccccuguguuuca

SEQ ID NO: 42516 - RNA, 22 nt, Homo sapiens
ugacuguguggaacgcagguga

SEQ ID NO: 42517 - RNA, 24 nt, Homo sapiens
cccgccuuuuuugcggccaccauu

SEQ ID NO: 42518 - RNA, 20 nt, Homo sapiens
acagaugaccaaagucccuu

SEQ ID NO: 42519 - RNA, 16 nt, Homo sapiens
agcccaccaggagcac

SEQ ID NO: 42520 - RNA, 20 nt, Homo sapiens
ccaggggagaaugcagccca

SEQ ID NO: 42521 - RNA, 22 nt, Homo sapiens
cccaggcccucccaccacccca

SEQ ID NO: 42522 - RNA, 18 nt, Homo sapiens
cccuucgacaugcugcca

SEQ ID NO: 42523 - RNA, 19 nt, Homo sapiens
ccgcugcccaccagccauc

SEQ ID NO: 42524 - RNA, 20 nt, Homo sapiens
ucaccacccccacuggcgag

SEQ ID NO: 42525 - RNA, 18 nt, Homo sapiens
ugagguccggguauucca

SEQ ID NO: 42526 - RNA, 20 nt, Homo sapiens
aaaauucaauugaagcugua

SEQ ID NO: 42527 - RNA, 21 nt, Homo sapiens
acgccagugccaagcucuuca

SEQ ID NO: 42528 - RNA, 17 nt, Homo sapiens
acuucaucaucuuguca

SEQ ID NO: 42529 - RNA, 20 nt, Homo sapiens
ccucccugcgggcugcugug

SEQ ID NO: 42530 - RNA, 18 nt, Homo sapiens
gcccggccgggcuuuuaa

SEQ ID NO: 42531 - RNA, 19 nt, Homo sapiens
ggcacgacugggguugguu

SEQ ID NO: 42532 - RNA, 20 nt, Homo sapiens
uacagucuccuugucccuca

SEQ ID NO: 42533 - RNA, 19 nt, Homo sapiens
ccaccgccggcuccgccca

SEQ ID NO: 42534 - RNA, 17 nt, Homo sapiens
cacugugcucucuguca

SEQ ID NO: 42535 - RNA, 21 nt, Homo sapiens
ugggguccuugggcuuuguca

SEQ ID NO: 42536 - RNA, 17 nt, Homo sapiens
agauccaaauagucaua

SEQ ID NO: 42537 - RNA, 21 nt, Homo sapiens
uggaguuuggcaaugaaacug

SEQ ID NO: 42538 - RNA, 23 nt, Homo sapiens
agcucgugugucuucucaacuga

SEQ ID NO: 42539 - RNA, 17 nt, Homo sapiens
aggccuguaggcauucu

SEQ ID NO: 42540 - RNA, 19 nt, Homo sapiens
caaugaaguaaauauauca

SEQ ID NO: 42541 - RNA, 19 nt, Homo sapiens
cacacccagcagucugcca

SEQ ID NO: 42542 - RNA, 15 nt, Homo sapiens
cccuccucugcuccu

SEQ ID NO: 42543 - RNA, 17 nt, Homo sapiens
gccccgcccccuccucu

SEQ ID NO: 42544 - RNA, 21 nt, Homo sapiens
gccuguccaagccucugugca

SEQ ID NO: 42545 - RNA, 19 nt, Homo sapiens
uguuaaaaugcagguuuga

SEQ ID NO: 42546 - RNA, 20 nt, Homo sapiens
uuccagaaagaagacgccag

SEQ ID NO: 42547 - RNA, 19 nt, Homo sapiens
gugaacuuuuccuccugga

SEQ ID NO: 42548 - RNA, 19 nt, Homo sapiens
acaaccugcacacggagcu

SEQ ID NO: 42549 - RNA, 22 nt, Homo sapiens
caccaccaccacgcgccugccu

SEQ ID NO: 42550 - RNA, 23 nt, Homo sapiens
gggcaccggacgaugugccucuc

SEQ ID NO: 42551 - RNA, 22 nt, Homo sapiens
gugcagccugcccgcuaccaca

SEQ ID NO: 42552 - RNA, 23 nt, Homo sapiens
ccacccucucucuaccugucacc

SEQ ID NO: 42553 - RNA, 19 nt, Homo sapiens
cugccaccacccucucucu

SEQ ID NO: 42554 - RNA, 20 nt, Homo sapiens
ugcccuccaauguggggcug

SEQ ID NO: 42555 - RNA, 25 nt, Homo sapiens
agcuacaggaauccaagaaccagug

SEQ ID NO: 42556 - RNA, 20 nt, Homo sapiens
gagcuccagaaaucugcaca

SEQ ID NO: 42557 - RNA, 17 nt, Homo sapiens
uccagaaaucugcacag

SEQ ID NO: 42558 - RNA, 22 nt, Homo sapiens
gccgucaucuccccucugccuc

SEQ ID NO: 42559 - RNA, 18 nt, Homo sapiens
caagagcauaggaguuuu

SEQ ID NO: 42560 - RNA, 19 nt, Homo sapiens
caugagaacuagaaaggaa

SEQ ID NO: 42561 - RNA, 16 nt, Homo sapiens
agggggagacagauuc

SEQ ID NO: 42562 - RNA, 20 nt, Homo sapiens
aucuuggccuccugggucuc

SEQ ID NO: 42563 - RNA, 17 nt, Homo sapiens
gcacacgacagcacuga

SEQ ID NO: 42564 - RNA, 20 nt, Homo sapiens
gcgugugcaccgugcgcgag

SEQ ID NO: 42565 - RNA, 21 nt, Homo sapiens
aucuuggcucacugcaaccuc

SEQ ID NO: 42566 - RNA, 25 nt, Homo sapiens
ccagcaugccaggcaacaggcggug

SEQ ID NO: 42567 - RNA, 23 nt, Homo sapiens
gccucccugccugcuccucugcc

SEQ ID NO: 42568 - RNA, 17 nt, Homo sapiens
ggacggggagcuugcca

SEQ ID NO: 42569 - RNA, 18 nt, Homo sapiens
uccgccuccuggguucaa

SEQ ID NO: 42570 - RNA, 23 nt, Homo sapiens
auguaugucauauauaugucuuu

SEQ ID NO: 42571 - RNA, 21 nt, Homo sapiens
gucuugaacuccuggguucaa

SEQ ID NO: 42572 - RNA, 19 nt, Homo sapiens
guucccaguaauuacagua

SEQ ID NO: 42573 - RNA, 21 nt, Homo sapiens
cccugaucuuugggucuugga

SEQ ID NO: 42574 - RNA, 19 nt, Homo sapiens
gaauuuuuuuuucccugga

SEQ ID NO: 42575 - RNA, 18 nt, Homo sapiens
gcgcuuaaauccaagacu

SEQ ID NO: 42576 - RNA, 22 nt, Homo sapiens
acaucauauauuuugauguuau

SEQ ID NO: 42577 - RNA, 25 nt, Homo sapiens
gaaaacaucauauauuuugauguua

SEQ ID NO: 42578 - RNA, 19 nt, Homo sapiens
gccugcccccagcacucua

SEQ ID NO: 42579 - RNA, 21 nt, Homo sapiens
uuguaaauaugcauauaugca

SEQ ID NO: 42580 - RNA, 21 nt, Homo sapiens
acaacucaaaaagagcagagc

SEQ ID NO: 42581 - RNA, 18 nt, Homo sapiens
acuacucgaguaaaugaa

SEQ ID NO: 42582 - RNA, 19 nt, Homo sapiens
ugacaacccauacaacuca

SEQ ID NO: 42583 - RNA, 18 nt, Homo sapiens
gggccacgggaguuccgg

SEQ ID NO: 42584 - RNA, 19 nt, Homo sapiens
acagcugucggccuccaug

SEQ ID NO: 42585 - RNA, 20 nt, Homo sapiens
augacacugccgcacacuca

SEQ ID NO: 42586 - RNA, 18 nt, Homo sapiens
cagcagaugucacucuga

SEQ ID NO: 42587 - RNA, 18 nt, Homo sapiens
aaugugaagaaugugaua

SEQ ID NO: 42588 - RNA, 25 nt, Homo sapiens
acucauacuggagagaaacauuaca

SEQ ID NO: 42589 - RNA, 19 nt, Homo sapiens
caaucacguuaccauauca

SEQ ID NO: 42590 - RNA, 19 nt, Homo sapiens
gaaugugaagaaugugaca

SEQ ID NO: 42591 - RNA, 21 nt, Homo sapiens
gcagcaggcagaccuuccaca

SEQ ID NO: 42592 - RNA, 22 nt, Homo sapiens
ugcuugacucugcuucuugcca

SEQ ID NO: 42593 - RNA, 19 nt, Homo sapiens
aaacuccuggccucaggug

SEQ ID NO: 42594 - RNA, 19 nt, Homo sapiens
ccgagagacacagugauga

SEQ ID NO: 42595 - RNA, 26 nt, Homo sapiens
ccucgugaucugccugccuuggccuu

SEQ ID NO: 42596 - RNA, 24 nt, Homo sapiens
gugcuuuggucauugcuccucucu

SEQ ID NO: 42597 - RNA, 16 nt, Homo sapiens
ugccauucuccugucu

SEQ ID NO: 42598 - RNA, 18 nt, Homo sapiens
aacacaucagaaaucuca

SEQ ID NO: 42599 - RNA, 20 nt, Homo sapiens
aucagaaaucucacuggaga

SEQ ID NO: 42600 - RNA, 19 nt, Homo sapiens
cccugucuccaccuugaua

SEQ ID NO: 42601 - RNA, 21 nt, Homo sapiens
uuuugaugaucuggcugugga

SEQ ID NO: 42602 - RNA, 17 nt, Homo sapiens
gugacaaugucuaguaa

SEQ ID NO: 42603 - RNA, 17 nt, Homo sapiens
ucaccauccccaguaaa

SEQ ID NO: 42604 - RNA, 17 nt, Homo sapiens
ucucccuucugcuguca

SEQ ID NO: 42605 - RNA, 19 nt, Homo sapiens
ucuggagagggccucugag

SEQ ID NO: 42606 - RNA, 17 nt, Homo sapiens
gaucauaugcugccuuu

SEQ ID NO: 42607 - RNA, 19 nt, Homo sapiens
cagacagaaccaggaacug

SEQ ID NO: 42608 - RNA, 20 nt, Homo sapiens
cccugaugcuggccugugag

SEQ ID NO: 42609 - RNA, 18 nt, Homo sapiens
cugcuguccagacaacuc

SEQ ID NO: 42610 - RNA, 19 nt, Homo sapiens
gggggcgguggcggugaca

SEQ ID NO: 42611 - RNA, 24 nt, Homo sapiens
uccuggugccgcagaggccucgga

SEQ ID NO: 42612 - RNA, 22 nt, Homo sapiens
gaccccgacagagggcgacggc

SEQ ID NO: 42613 - RNA, 20 nt, Homo sapiens
gcggcugcucacggcgcacg

SEQ ID NO: 42614 - RNA, 17 nt, Homo sapiens
ccuacaaacgugaagaa

SEQ ID NO: 42615 - RNA, 21 nt, Homo sapiens
gaagaauguggaaaagccauu

SEQ ID NO: 42616 - RNA, 21 nt, Homo sapiens
uuuuuucaguggcuuuaaccu

SEQ ID NO: 42617 - RNA, 23 nt, Homo sapiens
ccccgccccccaaccccacagcu

SEQ ID NO: 42618 - RNA, 21 nt, Homo sapiens
ccugucucaaaaaacaaaauc

SEQ ID NO: 42619 - RNA, 22 nt, Homo sapiens
ccuuuccaccuauuucccucca

SEQ ID NO: 42620 - RNA, 24 nt, Homo sapiens
gacaagcuuuuaccgacuuccucu

SEQ ID NO: 42621 - RNA, 18 nt, Homo sapiens
uccgccucccggguucaa

SEQ ID NO: 42622 - RNA, 19 nt, Homo sapiens
ugcccaccgccuucuccag

SEQ ID NO: 42623 - RNA, 20 nt, Homo sapiens
uggucaggcuggucuugaac

SEQ ID NO: 42624 - RNA, 23 nt, Homo sapiens
gcugugucugcaccgcuugguuu

SEQ ID NO: 42625 - RNA, 16 nt, Homo sapiens
uccagaucugcacugg

SEQ ID NO: 42626 - RNA, 24 nt, Homo sapiens
caagcacagaaagcacagucauca

SEQ ID NO: 42627 - RNA, 22 nt, Homo sapiens
ccccgcccaaccccaacucacu

SEQ ID NO: 42628 - RNA, 17 nt, Homo sapiens
aaaaacaaacaaacaaa

SEQ ID NO: 42629 - RNA, 18 nt, Homo sapiens
aucaccccuagugaccca

SEQ ID NO: 42630 - RNA, 23 nt, Homo sapiens
auuugagagacaacucuuggccu

SEQ ID NO: 42631 - RNA, 23 nt, Homo sapiens
auuuggguguauuacucuggccc

SEQ ID NO: 42632 - RNA, 18 nt, Homo sapiens
cagcuugcagacauccua

SEQ ID NO: 42633 - RNA, 22 nt, Homo sapiens
ccaaggcacucacuuuacagcu

SEQ ID NO: 42634 - RNA, 19 nt, Homo sapiens
ccaucaugguauuccacac

SEQ ID NO: 42635 - RNA, 18 nt, Homo sapiens
ccuggcugugucugugag

SEQ ID NO: 42636 - RNA, 21 nt, Homo sapiens
cguguuggcucccugacuggu

SEQ ID NO: 42637 - RNA, 21 nt, Homo sapiens
cuauugugggacccugugauu

SEQ ID NO: 42638 - RNA, 20 nt, Homo sapiens
gcaacagguccaggcugcug

SEQ ID NO: 42639 - RNA, 18 nt, Homo sapiens
gggaggcuguaauuguca

SEQ ID NO: 42640 - RNA, 21 nt, Homo sapiens
gguauucuuaacugccuuuuu

SEQ ID NO: 42641 - RNA, 23 nt, Homo sapiens
gguccaguggguccccagacuca

SEQ ID NO: 42642 - RNA, 19 nt, Homo sapiens
ucacaucccaacuccaaug

SEQ ID NO: 42643 - RNA, 17 nt, Homo sapiens
ucugaaucagcauccaa

SEQ ID NO: 42644 - RNA, 20 nt, Homo sapiens
uggauggaccucucugagug

SEQ ID NO: 42645 - RNA, 19 nt, Homo sapiens
ugggcuuugguggaaacug

SEQ ID NO: 42646 - RNA, 25 nt, Homo sapiens
uuaauacugagugucaacuugauug

SEQ ID NO: 42647 - RNA, 19 nt, Homo sapiens
cugauuguuuuaugugauu

SEQ ID NO: 42648 - RNA, 23 nt, Homo sapiens
aaaguaucaucagaaucauccca

SEQ ID NO: 42649 - RNA, 22 nt, Homo sapiens
accuggcccauaaauugucaua

SEQ ID NO: 42650 - RNA, 17 nt, Homo sapiens
augaugcagaaaggauc

SEQ ID NO: 42651 - RNA, 18 nt, Homo sapiens
caaagacugugccuaaaa

SEQ ID NO: 42652 - RNA, 21 nt, Homo sapiens
cauacauaugugcaagguuag

SEQ ID NO: 42653 - RNA, 23 nt, Homo sapiens
gugugugugucagugcucagcua

SEQ ID NO: 42654 - RNA, 28 nt, Homo sapiens
uaaguguuagagacuuuaauguaagcua

SEQ ID NO: 42655 - RNA, 23 nt, Homo sapiens
uuuuaacauaaccugggagaaga

SEQ ID NO: 42656 - RNA, 21 nt, Homo sapiens
acuugaucagucguuugaccu

SEQ ID NO: 42657 - RNA, 18 nt, Homo sapiens
agcuggauaaaaauguca

SEQ ID NO: 42658 - RNA, 17 nt, Homo sapiens
ucaagugauucucuugc

SEQ ID NO: 42659 - RNA, 22 nt, Homo sapiens
aaaugacucuuugagcaacuca

SEQ ID NO: 42660 - RNA, 20 nt, Homo sapiens
cugggacaucacacuuuuuu

SEQ ID NO: 42661 - RNA, 19 nt, Homo sapiens
cuguuucuccccccuagga

SEQ ID NO: 42662 - RNA, 24 nt, Homo sapiens
uuuugagaugguggaaucugugga

SEQ ID NO: 42663 - RNA, 19 nt, Homo sapiens
aaaaacaaaaacaaacaaa

SEQ ID NO: 42664 - RNA, 17 nt, Homo sapiens
aaaaacaaacaaacaaa

SEQ ID NO: 42665 - RNA, 18 nt, Homo sapiens
acuucccagaaguuauau

SEQ ID NO: 42666 - RNA, 18 nt, Homo sapiens
caacguccuccucucccu

SEQ ID NO: 42667 - RNA, 23 nt, Homo sapiens
caacugccugcaaccgccgcuga

SEQ ID NO: 42668 - RNA, 17 nt, Homo sapiens
ccccugugcagaugaca

SEQ ID NO: 42669 - RNA, 22 nt, Homo sapiens
gcacccgcuucaacugccugca

SEQ ID NO: 42670 - RNA, 24 nt, Homo sapiens
gccauucugcugggguucuggaga

SEQ ID NO: 42671 - RNA, 23 nt, Homo sapiens
caaacacaaauagagauuucaua

SEQ ID NO: 42672 - RNA, 18 nt, Homo sapiens
caagcaccagaucagaca

SEQ ID NO: 42673 - RNA, 23 nt, Homo sapiens
cagacaggcugugaagaagcucu

SEQ ID NO: 42674 - RNA, 22 nt, Homo sapiens
gaauuuugcaaugcucucugga

SEQ ID NO: 42675 - RNA, 19 nt, Homo sapiens
ggccaaggucaccacccug

SEQ ID NO: 42676 - RNA, 24 nt, Homo sapiens
guauaauauuagcuuauuugacua

SEQ ID NO: 42677 - RNA, 20 nt, Homo sapiens
cuuaccccacccccaccucc

SEQ ID NO: 42678 - RNA, 19 nt, Homo sapiens
cugcuucugcuguguggug

SEQ ID NO: 42679 - RNA, 18 nt, Homo sapiens
acucacauauuguguaca

SEQ ID NO: 42680 - RNA, 23 nt, Homo sapiens
cccugagucauggaggccugggg

SEQ ID NO: 42681 - RNA, 17 nt, Homo sapiens
gaccguagucgucugug

SEQ ID NO: 42682 - RNA, 18 nt, Homo sapiens
gaguucuguuuccgugga

SEQ ID NO: 42683 - RNA, 21 nt, Homo sapiens
gcaccacgcccacgcaggccc

SEQ ID NO: 42684 - RNA, 22 nt, Homo sapiens
gcccacgcaggcccacugugca

SEQ ID NO: 42685 - RNA, 19 nt, Homo sapiens
ugugugucaaaguugucca

SEQ ID NO: 42686 - RNA, 19 nt, Homo sapiens
aacacaaauacaguaucca

SEQ ID NO: 42687 - RNA, 22 nt, Homo sapiens
aagaccuaccaugcuggguagg

SEQ ID NO: 42688 - RNA, 18 nt, Homo sapiens
accgcacccggcuggcca

SEQ ID NO: 42689 - RNA, 19 nt, Homo sapiens
cgcugcaacccccaccucc

SEQ ID NO: 42690 - RNA, 17 nt, Homo sapiens
cggcuggccaaucuuau

SEQ ID NO: 42691 - RNA, 25 nt, Homo sapiens
cugggauuacaggcacccaccacua

SEQ ID NO: 42692 - RNA, 22 nt, Homo sapiens
gcucuaaagguuucuccuuugc

SEQ ID NO: 42693 - RNA, 18 nt, Homo sapiens
gguuccuaacccaaccua

SEQ ID NO: 42694 - RNA, 18 nt, Homo sapiens
uccugaccucaugaucca

SEQ ID NO: 42695 - RNA, 19 nt, Homo sapiens
ucuaucuucaggaaacccu

SEQ ID NO: 42696 - RNA, 20 nt, Homo sapiens
ucuugugcuuugcaccccug

SEQ ID NO: 42697 - RNA, 23 nt, Homo sapiens
uuucagucugcugcuuugcucuu

SEQ ID NO: 42698 - RNA, 23 nt, Homo sapiens
gaauacuuggaaaguuguuuaca

SEQ ID NO: 42699 - RNA, 21 nt, Homo sapiens
auauauuuuguuauaagacau

SEQ ID NO: 42700 - RNA, 17 nt, Homo sapiens
auuuuuuuaaacacuaa

SEQ ID NO: 42701 - RNA, 21 nt, Homo sapiens
uucauuugccagacgcuuuuu

SEQ ID NO: 42702 - RNA, 23 nt, Homo sapiens
uucuggcggugcugugcuuggaa

SEQ ID NO: 42703 - RNA, 19 nt, Homo sapiens
ugcaaagcaaaggcuccuu

SEQ ID NO: 42704 - RNA, 19 nt, Homo sapiens
ccccagccccugugccagg

SEQ ID NO: 42705 - RNA, 22 nt, Homo sapiens
gggacagccaggcaccugcucc

SEQ ID NO: 42706 - RNA, 20 nt, Homo sapiens
ugccuguggagggacuggag

SEQ ID NO: 42707 - RNA, 21 nt, Homo sapiens
ccuuuucgucagguuugacuu

SEQ ID NO: 42708 - RNA, 21 nt, Homo sapiens
uuacggugcgguugagaagua

SEQ ID NO: 42709 - RNA, 20 nt, Homo sapiens
agaaaauuagcaaugcugua

SEQ ID NO: 42710 - RNA, 19 nt, Homo sapiens
uggcuauauacccugacca

SEQ ID NO: 42711 - RNA, 24 nt, Homo sapiens
ccuacacagucagcuaagcaugaa

SEQ ID NO: 42712 - RNA, 18 nt, Homo sapiens
ggagagaaaaaacacuuu

SEQ ID NO: 42713 - RNA, 20 nt, Homo sapiens
uuuguauuuguuaccucuga

SEQ ID NO: 42714 - RNA, 18 nt, Homo sapiens
cguguacuggcuccucug

SEQ ID NO: 42715 - RNA, 20 nt, Homo sapiens
aaagccuuuuucaacauauc

SEQ ID NO: 42716 - RNA, 18 nt, Homo sapiens
aaauaccccaaacaugaa

SEQ ID NO: 42717 - RNA, 23 nt, Homo sapiens
aacuuaaucucaucuaauguaaa

SEQ ID NO: 42718 - RNA, 18 nt, Homo sapiens
accaaacucuggauuuaa

SEQ ID NO: 42719 - RNA, 18 nt, Homo sapiens
auauugauaccucugaua

SEQ ID NO: 42720 - RNA, 18 nt, Homo sapiens
auggaguucgugaacaca

SEQ ID NO: 42721 - RNA, 20 nt, Homo sapiens
auuuauacucuuuggacucc

SEQ ID NO: 42722 - RNA, 18 nt, Homo sapiens
gaauaacaacucagugaa

SEQ ID NO: 42723 - RNA, 21 nt, Homo sapiens
guucuucaccucuaagauggg

SEQ ID NO: 42724 - RNA, 21 nt, Homo sapiens
uacacucugauuccuauaaua

SEQ ID NO: 42725 - RNA, 23 nt, Homo sapiens
uagguggaaugcaucugagacua

SEQ ID NO: 42726 - RNA, 21 nt, Homo sapiens
ucccucgugucgccccucgga

SEQ ID NO: 42727 - RNA, 21 nt, Homo sapiens
ucuguauuucccauuucuuuu

SEQ ID NO: 42728 - RNA, 23 nt, Homo sapiens
uucuccugcuugucucagcuuca

SEQ ID NO: 42729 - RNA, 20 nt, Homo sapiens
agccacaugccagagauuca

SEQ ID NO: 42730 - RNA, 18 nt, Homo sapiens
aggugccuucuccaccca

SEQ ID NO: 42731 - RNA, 18 nt, Homo sapiens
uccccaccaggugauccg

SEQ ID NO: 42732 - RNA, 17 nt, Homo sapiens
ugucuaccaacuagaca

SEQ ID NO: 42733 - RNA, 16 nt, Homo sapiens
uucaucagagcucggc

SEQ ID NO: 42734 - RNA, 23 nt, Homo sapiens
acccacuggcuucccccuuccca

SEQ ID NO: 42735 - RNA, 24 nt, Homo sapiens
ccauguuuccccaccucuguuccu

SEQ ID NO: 42736 - RNA, 21 nt, Homo sapiens
cccaugcuggaggcuugugga

SEQ ID NO: 42737 - RNA, 18 nt, Homo sapiens
gcccaucucccauguuuc

SEQ ID NO: 42738 - RNA, 20 nt, Homo sapiens
uuguuuucucccuggacuuc

SEQ ID NO: 42739 - RNA, 19 nt, Homo sapiens
cacccugcugcccaacagc

SEQ ID NO: 42740 - RNA, 19 nt, Homo sapiens
gaaccguggccaacaguuc

SEQ ID NO: 42741 - RNA, 20 nt, Homo sapiens
aaaccaauggaggacucagg

SEQ ID NO: 42742 - RNA, 18 nt, Homo sapiens
ccaucaaaccaauggagg

SEQ ID NO: 42743 - RNA, 21 nt, Homo sapiens
cccugcuugagaagguuuugg

SEQ ID NO: 42744 - RNA, 21 nt, Homo sapiens
cuguccugcuuuugcuuccca

SEQ ID NO: 42745 - RNA, 20 nt, Homo sapiens
gcuggggcccaggaagagua

SEQ ID NO: 42746 - RNA, 17 nt, Homo sapiens
cuuguucucugccuuca

SEQ ID NO: 42747 - RNA, 18 nt, Homo sapiens
gcuugcugauccaacaaa

SEQ ID NO: 42748 - RNA, 19 nt, Homo sapiens
ugaagaaauaaguucagag

SEQ ID NO: 42749 - RNA, 22 nt, Homo sapiens
ccgacuuccuuuuuuugcuccu

SEQ ID NO: 42750 - RNA, 18 nt, Homo sapiens
gacccgccaggcacaccu

SEQ ID NO: 42751 - RNA, 20 nt, Homo sapiens
gcaaggcagcugcacaucca

SEQ ID NO: 42752 - RNA, 23 nt, Homo sapiens
ugaucacugugugccacacccca

SEQ ID NO: 42753 - RNA, 21 nt, Homo sapiens
ugcaagcccaguccucacuca

SEQ ID NO: 42754 - RNA, 18 nt, Homo sapiens
cacgcccacccuccuucu

SEQ ID NO: 42755 - RNA, 22 nt, Homo sapiens
cagccugaccaacacgaugaaa

SEQ ID NO: 42756 - RNA, 22 nt, Homo sapiens
gagccaagaucacaccacugca

SEQ ID NO: 42757 - RNA, 20 nt, Homo sapiens
aaaaucagacauuugaauau

SEQ ID NO: 42758 - RNA, 18 nt, Homo sapiens
ccguccccagaucaccua

SEQ ID NO: 42759 - RNA, 23 nt, Homo sapiens
ccguggcuuucugacacgugaca

SEQ ID NO: 42760 - RNA, 18 nt, Homo sapiens
cuucccuuucucuaccuu

SEQ ID NO: 42761 - RNA, 18 nt, Homo sapiens
ucaggugccuacuacuaa

SEQ ID NO: 42762 - RNA, 18 nt, Homo sapiens
uuaaaaucagacauuuga

SEQ ID NO: 42763 - RNA, 18 nt, Homo sapiens
gaaaauuuaaggaaauau

SEQ ID NO: 42764 - RNA, 21 nt, Homo sapiens
ugugacuacaaguacacacua

SEQ ID NO: 42765 - RNA, 18 nt, Homo sapiens
agggcagaugccaucaca

SEQ ID NO: 42766 - RNA, 18 nt, Homo sapiens
cacuucuuccuacauuga

SEQ ID NO: 42767 - RNA, 18 nt, Homo sapiens
ccauccagugccucguca

SEQ ID NO: 42768 - RNA, 22 nt, Homo sapiens
cccugaugaccagagccucgag

SEQ ID NO: 42769 - RNA, 15 nt, Homo sapiens
cuucugccaugacug

SEQ ID NO: 42770 - RNA, 22 nt, Homo sapiens
gcccagcaagucaauacauacu

SEQ ID NO: 42771 - RNA, 16 nt, Homo sapiens
ggccgccccuuccucu

SEQ ID NO: 42772 - RNA, 19 nt, Homo sapiens
gugucgugggaaggaccca

SEQ ID NO: 42773 - RNA, 24 nt, Homo sapiens
ugaauaaguuaauuucugccagug

SEQ ID NO: 42774 - RNA, 20 nt, Homo sapiens
uuuccgucuguuccuuuaaa

SEQ ID NO: 42775 - RNA, 20 nt, Homo sapiens
aacacagaagacuucuguga

SEQ ID NO: 42776 - RNA, 21 nt, Homo sapiens
agaaacucuaaguuccuggga

SEQ ID NO: 42777 - RNA, 21 nt, Homo sapiens
ccugaggccuucaaacagugg

SEQ ID NO: 42778 - RNA, 17 nt, Homo sapiens
ucuaccuggagauagug

SEQ ID NO: 42779 - RNA, 18 nt, Homo sapiens
accuccaacccuuaagca

SEQ ID NO: 42780 - RNA, 17 nt, Homo sapiens
augagagagacacagaa

SEQ ID NO: 42781 - RNA, 18 nt, Homo sapiens
auuggaggaucugugaca

SEQ ID NO: 42782 - RNA, 21 nt, Homo sapiens
gguucaccuguguuguagcaa

SEQ ID NO: 42783 - RNA, 25 nt, Homo sapiens
gucuccccuagaaacacauccaugg

SEQ ID NO: 42784 - RNA, 20 nt, Homo sapiens
guuuagaagaaaacauuaga

SEQ ID NO: 42785 - RNA, 22 nt, Homo sapiens
uucuccugcuucuuugcuuucc

SEQ ID NO: 42786 - RNA, 18 nt, Homo sapiens
ccaagcagaaugccucuc

SEQ ID NO: 42787 - RNA, 23 nt, Homo sapiens
cccaucuucagaaccaauggagg

SEQ ID NO: 42788 - RNA, 20 nt, Homo sapiens
cuggacgguggaggaccugc

SEQ ID NO: 42789 - RNA, 18 nt, Homo sapiens
gagcuacuccuccaacuc

SEQ ID NO: 42790 - RNA, 22 nt, Homo sapiens
gccugagugugcacuuuggcuc

SEQ ID NO: 42791 - RNA, 18 nt, Homo sapiens
gcuuguauguucuuuugg

SEQ ID NO: 42792 - RNA, 19 nt, Homo sapiens
gcuugucucggcagcuaag

SEQ ID NO: 42793 - RNA, 18 nt, Homo sapiens
gguuacagggaaaaccac

SEQ ID NO: 42794 - RNA, 19 nt, Homo sapiens
uccaggagcuacuccucca

SEQ ID NO: 42795 - RNA, 20 nt, Homo sapiens
aguuucacucugucgcccag

SEQ ID NO: 42796 - RNA, 20 nt, Homo sapiens
uggccaggcuggucuugaac

SEQ ID NO: 42797 - RNA, 18 nt, Homo sapiens
acaccacgccuugagcaa

SEQ ID NO: 42798 - RNA, 18 nt, Homo sapiens
accagacuccaucucaaa

SEQ ID NO: 42799 - RNA, 22 nt, Homo sapiens
ugcgugauugccaaagaccacu

SEQ ID NO: 42800 - RNA, 20 nt, Homo sapiens
uucugucucccugcccucug

SEQ ID NO: 42801 - RNA, 17 nt, Homo sapiens
acgcuuguaaucgcagc

SEQ ID NO: 42802 - RNA, 19 nt, Homo sapiens
ccguggaggcagcuagcuc

SEQ ID NO: 42803 - RNA, 21 nt, Homo sapiens
gaacuuaauaauaaugagaca

SEQ ID NO: 42804 - RNA, 18 nt, Homo sapiens
gauaugugcagccgggua

SEQ ID NO: 42805 - RNA, 23 nt, Homo sapiens
aaaguaaagaauaugaugaguac

SEQ ID NO: 42806 - RNA, 22 nt, Homo sapiens
acaggcaagcuaaagaaaccuc

SEQ ID NO: 42807 - RNA, 17 nt, Homo sapiens
gugaugacaacuuuggu

SEQ ID NO: 42808 - RNA, 18 nt, Homo sapiens
ugaguggauccugaaaug

SEQ ID NO: 42809 - RNA, 27 nt, Homo sapiens
ccagucauggaguuaagaagugaguca

SEQ ID NO: 42810 - RNA, 23 nt, Homo sapiens
ccauacaacaggacuaugugaug

SEQ ID NO: 42811 - RNA, 21 nt, Homo sapiens
uccacagacacuacccaaagc

SEQ ID NO: 42812 - RNA, 19 nt, Homo sapiens
uccucaacaaaauacuggc

SEQ ID NO: 42813 - RNA, 19 nt, Homo sapiens
caugucucccagccccuga

SEQ ID NO: 42814 - RNA, 19 nt, Homo sapiens
cucaguggcuucuuggagu

SEQ ID NO: 42815 - RNA, 16 nt, Homo sapiens
ggacacaccugccaag

SEQ ID NO: 42816 - RNA, 21 nt, Homo sapiens
ccaauauccagaaaacauucu

SEQ ID NO: 42817 - RNA, 23 nt, Homo sapiens
acaaaacaccauguggagacuca

SEQ ID NO: 42818 - RNA, 21 nt, Homo sapiens
gccaggaaaaugcccugugug

SEQ ID NO: 42819 - RNA, 16 nt, Homo sapiens
gcauuuauaugugcau

SEQ ID NO: 42820 - RNA, 19 nt, Homo sapiens
uuuuuuguugccuugccuu

SEQ ID NO: 42821 - RNA, 18 nt, Homo sapiens
ccuugucaaaucgucuua

SEQ ID NO: 42822 - RNA, 18 nt, Homo sapiens
cccugugggcagccgugc

SEQ ID NO: 42823 - RNA, 19 nt, Homo sapiens
accaaggaccugcucacca

SEQ ID NO: 42824 - RNA, 22 nt, Homo sapiens
gccugggccguggcagccgccu

SEQ ID NO: 42825 - RNA, 20 nt, Homo sapiens
ggaggaggcugggcagggcc

SEQ ID NO: 42826 - RNA, 17 nt, Homo sapiens
ucuguccugggcgcugc

SEQ ID NO: 42827 - RNA, 19 nt, Homo sapiens
agagauucauugcagcuca

SEQ ID NO: 42828 - RNA, 21 nt, Homo sapiens
aagaugcacaauggcuaguca

SEQ ID NO: 42829 - RNA, 18 nt, Homo sapiens
auacuuuugaaucacuua

SEQ ID NO: 42830 - RNA, 20 nt, Homo sapiens
auguggaaauagcucugaug

SEQ ID NO: 42831 - RNA, 20 nt, Homo sapiens
auuuuauuuauauuucuggu

SEQ ID NO: 42832 - RNA, 18 nt, Homo sapiens
caaacugugacucugugu

SEQ ID NO: 42833 - RNA, 18 nt, Homo sapiens
cccuccaccgccagaaga

SEQ ID NO: 42834 - RNA, 18 nt, Homo sapiens
ccugauccagucugugaa

SEQ ID NO: 42835 - RNA, 28 nt, Homo sapiens
uccaccgccagaagacugaauugaccaa

SEQ ID NO: 42836 - RNA, 21 nt, Homo sapiens
ugggguuguuuaacaugaaac

SEQ ID NO: 42837 - RNA, 18 nt, Homo sapiens
uguuugcauuucaacugc

SEQ ID NO: 42838 - RNA, 24 nt, Homo sapiens
uuaacagcuuuuugguuauuuuua

SEQ ID NO: 42839 - RNA, 19 nt, Homo sapiens
aaagccaaauuucccaugu

SEQ ID NO: 42840 - RNA, 20 nt, Homo sapiens
gccacggaggaggcuucuaa

SEQ ID NO: 42841 - RNA, 20 nt, Homo sapiens
uacuauuaacaaucuguaac

SEQ ID NO: 42842 - RNA, 19 nt, Homo sapiens
ucccauguaagcugcaguu

SEQ ID NO: 42843 - RNA, 19 nt, Homo sapiens
ucugcugcggcgcccucuu

SEQ ID NO: 42844 - RNA, 22 nt, Homo sapiens
uucaacugcauugcauccucuu

SEQ ID NO: 42845 - RNA, 24 nt, Homo sapiens
uuucuaucuuuagcccaucaucau

SEQ ID NO: 42846 - RNA, 24 nt, Homo sapiens
accguuccccaucucucucccucu

SEQ ID NO: 42847 - RNA, 23 nt, Homo sapiens
cccacagaccguuccccaucucu

SEQ ID NO: 42848 - RNA, 27 nt, Homo sapiens
uucugaaaacaaauggaggguuugugg

SEQ ID NO: 42849 - RNA, 23 nt, Homo sapiens
aacaaaaaaggcagaugugcaag

SEQ ID NO: 42850 - RNA, 17 nt, Homo sapiens
ccugguauaaaacuaca

SEQ ID NO: 42851 - RNA, 20 nt, Homo sapiens
cucuacaaugcuaauucugg

SEQ ID NO: 42852 - RNA, 20 nt, Homo sapiens
gaucugguuuuaaugaugaa

SEQ ID NO: 42853 - RNA, 19 nt, Homo sapiens
ggaaccugguauaaaacua

SEQ ID NO: 42854 - RNA, 23 nt, Homo sapiens
uuucuccccaauaccaccaacga

SEQ ID NO: 42855 - RNA, 20 nt, Homo sapiens
aguuguauuggauuacauua

SEQ ID NO: 42856 - RNA, 17 nt, Homo sapiens
augauacagaaaguauc

SEQ ID NO: 42857 - RNA, 21 nt, Homo sapiens
cucaaaaacaugaaagggcau

SEQ ID NO: 42858 - RNA, 17 nt, Homo sapiens
ggaaaaaagacaagcaa

SEQ ID NO: 42859 - RNA, 19 nt, Homo sapiens
gugccuuaaaauggugaac

SEQ ID NO: 42860 - RNA, 21 nt, Homo sapiens
guguaaauguuuuuuaggaua

SEQ ID NO: 42861 - RNA, 20 nt, Homo sapiens
uggauuuaauuaugaggcua

SEQ ID NO: 42862 - RNA, 18 nt, Homo sapiens
aaauaccauucugaugua

SEQ ID NO: 42863 - RNA, 22 nt, Homo sapiens
cucuugaagacgcaucacugga

SEQ ID NO: 42864 - RNA, 18 nt, Homo sapiens
uccgccucucggguucaa

SEQ ID NO: 42865 - RNA, 19 nt, Homo sapiens
uguuucuuucuaugcauau

SEQ ID NO: 42866 - RNA, 18 nt, Homo sapiens
augcaugcgaggugcuuc

SEQ ID NO: 42867 - RNA, 22 nt, Homo sapiens
gccuggauuccaguccuggcuc

SEQ ID NO: 42868 - RNA, 23 nt, Homo sapiens
gcucugaaguugcagggcugcga

SEQ ID NO: 42869 - RNA, 18 nt, Homo sapiens
ucugcccuucuuuuugca

SEQ ID NO: 42870 - RNA, 16 nt, Homo sapiens
uccaugccugucccag

SEQ ID NO: 42871 - RNA, 21 nt, Homo sapiens
cuggaguugaccaggccuacc

SEQ ID NO: 42872 - RNA, 21 nt, Homo sapiens
ucuacacugcugguuguauga

SEQ ID NO: 42873 - RNA, 22 nt, Homo sapiens
uuggguuaggggagccuuuguc

SEQ ID NO: 42874 - RNA, 19 nt, Homo sapiens
aaugagagaggcggccggc

SEQ ID NO: 42875 - RNA, 21 nt, Homo sapiens
uuccugccuacccgcacuguc

SEQ ID NO: 42876 - RNA, 18 nt, Homo sapiens
caggcuuccuguuuguaa

SEQ ID NO: 42877 - RNA, 16 nt, Homo sapiens
gagcuccuggaucuca

SEQ ID NO: 42878 - RNA, 20 nt, Homo sapiens
uguaaaauagacagaauucc

SEQ ID NO: 42879 - RNA, 17 nt, Homo sapiens
cugugugguuuuguuuu

SEQ ID NO: 42880 - RNA, 22 nt, Homo sapiens
gccccgcgggaccugugcaagc

SEQ ID NO: 42881 - RNA, 21 nt, Homo sapiens
ugacuagacgguccgcagggg

SEQ ID NO: 42882 - RNA, 22 nt, Homo sapiens
accaaaacaaacuuuucaauga

SEQ ID NO: 42883 - RNA, 24 nt, Homo sapiens
gccuuuuuuccucccccauccccu

SEQ ID NO: 42884 - RNA, 17 nt, Homo sapiens
gugcuugacugcaugcu

SEQ ID NO: 42885 - RNA, 22 nt, Homo sapiens
uuucacagcaccauucucagaa

SEQ ID NO: 42886 - RNA, 20 nt, Homo sapiens
gcggaggaggagagcuagac

SEQ ID NO: 42887 - RNA, 21 nt, Homo sapiens
accuuauccagaaggaacuca

SEQ ID NO: 42888 - RNA, 21 nt, Homo sapiens
gaugucuucguuaugaaacug

SEQ ID NO: 42889 - RNA, 19 nt, Homo sapiens
guacaaaugaacacaguuu

SEQ ID NO: 42890 - RNA, 21 nt, Homo sapiens
ucaaagcuuauauguaaacuu

SEQ ID NO: 42891 - RNA, 21 nt, Homo sapiens
ucuucagguuucaguucuuca

SEQ ID NO: 42892 - RNA, 20 nt, Homo sapiens
uggccaggcuggucuugaac

SEQ ID NO: 42893 - RNA, 20 nt, Homo sapiens
aacaguagcaaaagaugcca

SEQ ID NO: 42894 - RNA, 16 nt, Homo sapiens
aaggcaucuaguauua

SEQ ID NO: 42895 - RNA, 22 nt, Homo sapiens
auuugaaagaaaucguuugccu

SEQ ID NO: 42896 - RNA, 18 nt, Homo sapiens
caggguagaaagacugua

SEQ ID NO: 42897 - RNA, 19 nt, Homo sapiens
ucuuaugagagacuugugg

SEQ ID NO: 42898 - RNA, 20 nt, Homo sapiens
ugagacugugucucaacaaa

SEQ ID NO: 42899 - RNA, 22 nt, Homo sapiens
ugcaagugauuguccugccuca

SEQ ID NO: 42900 - RNA, 20 nt, Homo sapiens
ccucugacuccuggguucaa

SEQ ID NO: 42901 - RNA, 18 nt, Homo sapiens
cucccucccucugccuuu

SEQ ID NO: 42902 - RNA, 21 nt, Homo sapiens
gcgccuccuucugcggacucu

SEQ ID NO: 42903 - RNA, 20 nt, Homo sapiens
ugggaggccugagguucuga

SEQ ID NO: 42904 - RNA, 21 nt, Homo sapiens
aucaaauuuaaaugaugugau

SEQ ID NO: 42905 - RNA, 21 nt, Homo sapiens
gggucacacaacauucacuaa

SEQ ID NO: 42906 - RNA, 20 nt, Homo sapiens
cacauguuaugcucuuuuca

SEQ ID NO: 42907 - RNA, 25 nt, Homo sapiens
cuucacaaggguugcaaaaaguaga

SEQ ID NO: 42908 - RNA, 18 nt, Homo sapiens
guggcaaugaaaugccau

SEQ ID NO: 42909 - RNA, 18 nt, Homo sapiens
ugaaaugccauaguauua

SEQ ID NO: 42910 - RNA, 25 nt, Homo sapiens
gcccccgacgccgccgagcacguca

SEQ ID NO: 42911 - RNA, 20 nt, Homo sapiens
aagaacuaauguucuccuca

SEQ ID NO: 42912 - RNA, 19 nt, Homo sapiens
cauggaaaagacaccaaac

SEQ ID NO: 42913 - RNA, 18 nt, Homo sapiens
cauggccaggucugguca

SEQ ID NO: 42914 - RNA, 23 nt, Homo sapiens
ccauacaaugaaagcuauaacua

SEQ ID NO: 42915 - RNA, 20 nt, Homo sapiens
cuaauguucuccucagcuga

SEQ ID NO: 42916 - RNA, 19 nt, Homo sapiens
cucuccuuggauaccugau

SEQ ID NO: 42917 - RNA, 19 nt, Homo sapiens
cuuucucucuuuagguauc

SEQ ID NO: 42918 - RNA, 25 nt, Homo sapiens
uguagguaggaaguaugugcaggug

SEQ ID NO: 42919 - RNA, 20 nt, Homo sapiens
aaacacugauguugauuuca

SEQ ID NO: 42920 - RNA, 20 nt, Homo sapiens
ugaaugcagaacuugccagu

SEQ ID NO: 42921 - RNA, 19 nt, Homo sapiens
augggagcccccauaccca

SEQ ID NO: 42922 - RNA, 25 nt, Homo sapiens
ccucugacaccuugacuuuagccuu

SEQ ID NO: 42923 - RNA, 20 nt, Homo sapiens
uucaagaccagccuagccaa

SEQ ID NO: 42924 - RNA, 22 nt, Homo sapiens
accagagaguggguccucagca

SEQ ID NO: 42925 - RNA, 22 nt, Homo sapiens
agaaaauuagaaccacgcugua

SEQ ID NO: 42926 - RNA, 22 nt, Homo sapiens
gaaccaagaucgcaccacugca

SEQ ID NO: 42927 - RNA, 22 nt, Homo sapiens
gauagguuuuuaaauugcuuuu

SEQ ID NO: 42928 - RNA, 18 nt, Homo sapiens
uggguggaucacuugagg

SEQ ID NO: 42929 - RNA, 18 nt, Homo sapiens
ccuuggucaaauccuuca

SEQ ID NO: 42930 - RNA, 16 nt, Homo sapiens
ugcuguuagcacuguu

SEQ ID NO: 42931 - RNA, 19 nt, Homo sapiens
agcuaaauaguuugaauua

SEQ ID NO: 42932 - RNA, 24 nt, Homo sapiens
ccucugggccgcugccuucgcuuu

SEQ ID NO: 42933 - RNA, 24 nt, Homo sapiens
cuuuuuguaguuucuuuuaauuuu

SEQ ID NO: 42934 - RNA, 21 nt, Homo sapiens
gucaucuguuuaacacuccca

SEQ ID NO: 42935 - RNA, 19 nt, Homo sapiens
uacuccauagugcaaucca

SEQ ID NO: 42936 - RNA, 19 nt, Homo sapiens
uguggguaguauuuguggu

SEQ ID NO: 42937 - RNA, 16 nt, Homo sapiens
acacccaucugcagua

SEQ ID NO: 42938 - RNA, 24 nt, Homo sapiens
agugugucucaaggggcauuugug

SEQ ID NO: 42939 - RNA, 18 nt, Homo sapiens
aguucuccggauauucac

SEQ ID NO: 42940 - RNA, 18 nt, Homo sapiens
cuucccgccucugccccu

SEQ ID NO: 42941 - RNA, 24 nt, Homo sapiens
gaccgcgcguccgccccaguccca

SEQ ID NO: 42942 - RNA, 22 nt, Homo sapiens
ggagcugagccccgcccugcca

SEQ ID NO: 42943 - RNA, 27 nt, Homo sapiens
gugucucaaggggcauuugugagcuuu

SEQ ID NO: 42944 - RNA, 21 nt, Homo sapiens
uucacaaaacugccuuccaug

SEQ ID NO: 42945 - RNA, 18 nt, Homo sapiens
aaugaacaagaaaaagua

SEQ ID NO: 42946 - RNA, 18 nt, Homo sapiens
acagcuuaaaaaugugaa

SEQ ID NO: 42947 - RNA, 18 nt, Homo sapiens
aguagaaguguuaucccc

SEQ ID NO: 42948 - RNA, 17 nt, Homo sapiens
auagugcuuuuuccuga

SEQ ID NO: 42949 - RNA, 20 nt, Homo sapiens
gauuccaguagauggaauug

SEQ ID NO: 42950 - RNA, 19 nt, Homo sapiens
ucuggagagagccugugaa

SEQ ID NO: 42951 - RNA, 18 nt, Homo sapiens
ugaccauugcuacaugug

SEQ ID NO: 42952 - RNA, 22 nt, Homo sapiens
ugacccugucugagccaaauga

SEQ ID NO: 42953 - RNA, 21 nt, Homo sapiens
gcuggcgcgccggcggacuuu

SEQ ID NO: 42954 - RNA, 20 nt, Homo sapiens
gggcuucugagcuuucuuca

SEQ ID NO: 42955 - RNA, 17 nt, Homo sapiens
uauugccuuugccuuug

SEQ ID NO: 42956 - RNA, 20 nt, Homo sapiens
aaggccucuucaguauaagg

SEQ ID NO: 42957 - RNA, 16 nt, Homo sapiens
aauucaaaacugucaa

SEQ ID NO: 42958 - RNA, 21 nt, Homo sapiens
gcuuuaaaacuaauuacuuca

SEQ ID NO: 42959 - RNA, 19 nt, Homo sapiens
gcuucugugggauauuuug

SEQ ID NO: 42960 - RNA, 22 nt, Homo sapiens
aguaccacaaaaacuguguugu

SEQ ID NO: 42961 - RNA, 21 nt, Homo sapiens
aguguuagccacaaaaggcua

SEQ ID NO: 42962 - RNA, 20 nt, Homo sapiens
aucuccaaagaaaaguucau

SEQ ID NO: 42963 - RNA, 15 nt, Homo sapiens
auuacagauuuuauc

SEQ ID NO: 42964 - RNA, 18 nt, Homo sapiens
aaaugggaaaauggcuuu

SEQ ID NO: 42965 - RNA, 20 nt, Homo sapiens
aucgacaaaagaaccauuga

SEQ ID NO: 42966 - RNA, 18 nt, Homo sapiens
ugcggggcccaaguccuu

SEQ ID NO: 42967 - RNA, 22 nt, Homo sapiens
aagcaagaacaccaacuugaac

SEQ ID NO: 42968 - RNA, 18 nt, Homo sapiens
gcaguggacugugugauu

SEQ ID NO: 42969 - RNA, 19 nt, Homo sapiens
ggcgucugugaaaacccca

SEQ ID NO: 42970 - RNA, 22 nt, Homo sapiens
aaaaucgacaagaaaaccuuga

SEQ ID NO: 42971 - RNA, 21 nt, Homo sapiens
agaaaugacagccagcaccuc

SEQ ID NO: 42972 - RNA, 18 nt, Homo sapiens
auaacaaauggauugaug

SEQ ID NO: 42973 - RNA, 25 nt, Homo sapiens
gccaccagcuccgacgaugggacug

SEQ ID NO: 42974 - RNA, 20 nt, Homo sapiens
uccaucagcauacgauauca

SEQ ID NO: 42975 - RNA, 19 nt, Homo sapiens
uggagaacaauugcuuagg

SEQ ID NO: 42976 - RNA, 18 nt, Homo sapiens
uucuucauauuucaccuu

SEQ ID NO: 42977 - RNA, 16 nt, Homo sapiens
uuguuaauuuuggugu

SEQ ID NO: 42978 - RNA, 21 nt, Homo sapiens
uuucgagaucuucuccgcccc

SEQ ID NO: 42979 - RNA, 22 nt, Homo sapiens
acacacaaggaauaaaacaaac

SEQ ID NO: 42980 - RNA, 21 nt, Homo sapiens
agugauuuauuccauaaggaa

SEQ ID NO: 42981 - RNA, 21 nt, Homo sapiens
cagccgcacagcaggagguga

SEQ ID NO: 42982 - RNA, 22 nt, Homo sapiens
ccuucccuggugauucuuucca

SEQ ID NO: 42983 - RNA, 18 nt, Homo sapiens
gaaaggugaugacagagg

SEQ ID NO: 42984 - RNA, 18 nt, Homo sapiens
gaccuaaauaacugggaa

SEQ ID NO: 42985 - RNA, 23 nt, Homo sapiens
uaugcugcuccaauuucauaaca

SEQ ID NO: 42986 - RNA, 24 nt, Homo sapiens
gcgcggaggaggagcagcgcggga

SEQ ID NO: 42987 - RNA, 17 nt, Homo sapiens
agaagaaccuggaccau

SEQ ID NO: 42988 - RNA, 24 nt, Homo sapiens
cagaaaaaaacauaauucugguga

SEQ ID NO: 42989 - RNA, 20 nt, Homo sapiens
cuggaccauucuugauggag

SEQ ID NO: 42990 - RNA, 18 nt, Homo sapiens
cuuuucauccuaaaucuu

SEQ ID NO: 42991 - RNA, 19 nt, Homo sapiens
aaggguaacaccuucauga

SEQ ID NO: 42992 - RNA, 16 nt, Homo sapiens
ccugcugugcuccaca

SEQ ID NO: 42993 - RNA, 19 nt, Homo sapiens
aagcaauucuccugccuca

SEQ ID NO: 42994 - RNA, 19 nt, Homo sapiens
aguugaccacugcagcagu

SEQ ID NO: 42995 - RNA, 22 nt, Homo sapiens
ccaccggucccagaacccgcca

SEQ ID NO: 42996 - RNA, 17 nt, Homo sapiens
ccaguugaagcaccugu

SEQ ID NO: 42997 - RNA, 20 nt, Homo sapiens
ggucuccaaccacagggcca

SEQ ID NO: 42998 - RNA, 17 nt, Homo sapiens
ucaagugauucuccugc

SEQ ID NO: 42999 - RNA, 18 nt, Homo sapiens
aacuccaucucaaucaau

SEQ ID NO: 43000 - RNA, 27 nt, Homo sapiens
agaaguaccgacacucccuauccuuca

SEQ ID NO: 43001 - RNA, 20 nt, Homo sapiens
ggggacgccgagggcggcug

SEQ ID NO: 43002 - RNA, 19 nt, Homo sapiens
cuguucgccucccauucua

SEQ ID NO: 43003 - RNA, 19 nt, Homo sapiens
cugaacguaguggagauga

SEQ ID NO: 43004 - RNA, 18 nt, Homo sapiens
auuuccucauuugccuua

SEQ ID NO: 43005 - RNA, 21 nt, Homo sapiens
acuuggaucacggcuugguuc

SEQ ID NO: 43006 - RNA, 21 nt, Homo sapiens
ucuuuccagucgcuguaugua

SEQ ID NO: 43007 - RNA, 17 nt, Homo sapiens
aaggauccccagccccc

SEQ ID NO: 43008 - RNA, 24 nt, Homo sapiens
acacagccaacccugcugcucucu

SEQ ID NO: 43009 - RNA, 24 nt, Homo sapiens
caacccugcugcucucugccuccu

SEQ ID NO: 43010 - RNA, 19 nt, Homo sapiens
cucccccauauuuugugaa

SEQ ID NO: 43011 - RNA, 18 nt, Homo sapiens
uccuuguuugacaucuca

SEQ ID NO: 43012 - RNA, 27 nt, Homo sapiens
ugcaaauugcuuuccaaacucacuuga

SEQ ID NO: 43013 - RNA, 20 nt, Homo sapiens
uggccaagcuggucuugaac

SEQ ID NO: 43014 - RNA, 18 nt, Homo sapiens
uucaagugauucucaugc

SEQ ID NO: 43015 - RNA, 22 nt, Homo sapiens
accuggguuugccucuuggcuc

SEQ ID NO: 43016 - RNA, 23 nt, Homo sapiens
acuugguauccuuuagagaaaaa

SEQ ID NO: 43017 - RNA, 20 nt, Homo sapiens
cacaugugugaccucucuga

SEQ ID NO: 43018 - RNA, 22 nt, Homo sapiens
cccuccccgacucccacuucca

SEQ ID NO: 43019 - RNA, 21 nt, Homo sapiens
uagaugagauagcugaggcua

SEQ ID NO: 43020 - RNA, 19 nt, Homo sapiens
ucucugacuucucuuccuc

SEQ ID NO: 43021 - RNA, 21 nt, Homo sapiens
uuuccggcuugcuuugacuuu

SEQ ID NO: 43022 - RNA, 18 nt, Homo sapiens
cauaaccacuucugcccc

SEQ ID NO: 43023 - RNA, 17 nt, Homo sapiens
ccagcuggacccccuuu

SEQ ID NO: 43024 - RNA, 19 nt, Homo sapiens
ccuuuuuucccuuaucccc

SEQ ID NO: 43025 - RNA, 18 nt, Homo sapiens
gcggccucaaaguucuga

SEQ ID NO: 43026 - RNA, 17 nt, Homo sapiens
gcuguuuuccaugaccg

SEQ ID NO: 43027 - RNA, 17 nt, Homo sapiens
gggcgguuccugaagug

SEQ ID NO: 43028 - RNA, 22 nt, Homo sapiens
cgggcgcaucacgaggucagga

SEQ ID NO: 43029 - RNA, 20 nt, Homo sapiens
uaaggguugacaccauucuc

SEQ ID NO: 43030 - RNA, 17 nt, Homo sapiens
cgacugugugccuguca

SEQ ID NO: 43031 - RNA, 16 nt, Homo sapiens
aaauucuuuggauugc

SEQ ID NO: 43032 - RNA, 23 nt, Homo sapiens
ggcgugagccaccacgcccggcc

SEQ ID NO: 43033 - RNA, 22 nt, Homo sapiens
guucaaaagagagcucccugga

SEQ ID NO: 43034 - RNA, 24 nt, Homo sapiens
guaagccugugguaguuuuuuuga

SEQ ID NO: 43035 - RNA, 19 nt, Homo sapiens
aaggaccagcaacucaugg

SEQ ID NO: 43036 - RNA, 22 nt, Homo sapiens
aaugggagcaguccauggugca

SEQ ID NO: 43037 - RNA, 17 nt, Homo sapiens
caucgcccaguacacca

SEQ ID NO: 43038 - RNA, 19 nt, Homo sapiens
gauuacauaaaugccuggc

SEQ ID NO: 43039 - RNA, 20 nt, Homo sapiens
ggguagcaacaaguacauca

SEQ ID NO: 43040 - RNA, 17 nt, Homo sapiens
ucccgacaccugcucac

SEQ ID NO: 43041 - RNA, 19 nt, Homo sapiens
ccccacggagacgcgccaa

SEQ ID NO: 43042 - RNA, 19 nt, Homo sapiens
gcgcuuggugacgauccca

SEQ ID NO: 43043 - RNA, 20 nt, Homo sapiens
cauuugacacacauacucaa

SEQ ID NO: 43044 - RNA, 23 nt, Homo sapiens
cgggcggggccuggggcccgcca

SEQ ID NO: 43045 - RNA, 22 nt, Homo sapiens
gggcggggccuggggcccgcca

SEQ ID NO: 43046 - RNA, 24 nt, Homo sapiens
aaaagaaauugggagaguauauca

SEQ ID NO: 43047 - RNA, 25 nt, Homo sapiens
acuacaugaugacagaauuauauca

SEQ ID NO: 43048 - RNA, 18 nt, Homo sapiens
cagcaccaaugcaagugc

SEQ ID NO: 43049 - RNA, 20 nt, Homo sapiens
cauggcugaagcaagcauca

SEQ ID NO: 43050 - RNA, 20 nt, Homo sapiens
cauggcuggagcaaguauca

SEQ ID NO: 43051 - RNA, 20 nt, Homo sapiens
ggucagugucuguugcacaa

SEQ ID NO: 43052 - RNA, 20 nt, Homo sapiens
agaaaauuucauuugugcug

SEQ ID NO: 43053 - RNA, 21 nt, Homo sapiens
gaaacuaugcaaaacaaaaca

SEQ ID NO: 43054 - RNA, 20 nt, Homo sapiens
ggagcuuccagaugggcauc

SEQ ID NO: 43055 - RNA, 23 nt, Homo sapiens
augcaucauuugugcaguuugaa

SEQ ID NO: 43056 - RNA, 19 nt, Homo sapiens
cccaacucauugaauguga

SEQ ID NO: 43057 - RNA, 24 nt, Homo sapiens
ccuuuuuguaguauuuuuagucuu

SEQ ID NO: 43058 - RNA, 26 nt, Homo sapiens
ucugggggaaaucuugggaugcuuuu

SEQ ID NO: 43059 - RNA, 18 nt, Homo sapiens
accaccucuaccccuuuc

SEQ ID NO: 43060 - RNA, 17 nt, Homo sapiens
acccagauuugcacuca

SEQ ID NO: 43061 - RNA, 21 nt, Homo sapiens
caccuuuuggauuuuccacau

SEQ ID NO: 43062 - RNA, 21 nt, Homo sapiens
cauguaugauacagugaguca

SEQ ID NO: 43063 - RNA, 17 nt, Homo sapiens
gaccucaaaccagcuua

SEQ ID NO: 43064 - RNA, 26 nt, Homo sapiens
uucuacugcagcagcugcuacucuuu

SEQ ID NO: 43065 - RNA, 18 nt, Homo sapiens
uuucuacauaauauggua

SEQ ID NO: 43066 - RNA, 21 nt, Homo sapiens
uuuguguuauugugauugcug

SEQ ID NO: 43067 - RNA, 22 nt, Homo sapiens
ccgaggcccccaagccauccca

SEQ ID NO: 43068 - RNA, 21 nt, Homo sapiens
cgcaggccgacccugcugccu

SEQ ID NO: 43069 - RNA, 18 nt, Homo sapiens
cugccugcagagcgcugc

SEQ ID NO: 43070 - RNA, 22 nt, Homo sapiens
gccugggccgcggucguggucc

SEQ ID NO: 43071 - RNA, 18 nt, Homo sapiens
ggaucaggcagcacccag

SEQ ID NO: 43072 - RNA, 24 nt, Homo sapiens
ggggaggagaucugggcccaguca

SEQ ID NO: 43073 - RNA, 21 nt, Homo sapiens
uagguucuucagcagcagcca

SEQ ID NO: 43074 - RNA, 19 nt, Homo sapiens
uccagagaagacaucccag

SEQ ID NO: 43075 - RNA, 23 nt, Homo sapiens
ugaguucuccgacgcccacauga

SEQ ID NO: 43076 - RNA, 17 nt, Homo sapiens
accgcaugucacugcua

SEQ ID NO: 43077 - RNA, 20 nt, Homo sapiens
ggggaggaagcugccaguca

SEQ ID NO: 43078 - RNA, 20 nt, Homo sapiens
aaaucccaaaagucacacuu

SEQ ID NO: 43079 - RNA, 20 nt, Homo sapiens
cccccuucagcaggcaccuc

SEQ ID NO: 43080 - RNA, 25 nt, Homo sapiens
uccccagggcaggcccagcgugcug

SEQ ID NO: 43081 - RNA, 17 nt, Homo sapiens
caccagugggcacaucg

SEQ ID NO: 43082 - RNA, 22 nt, Homo sapiens
ggcaggucaugccauuguuguc

SEQ ID NO: 43083 - RNA, 21 nt, Homo sapiens
agcugagcaaccgcucugucu

SEQ ID NO: 43084 - RNA, 18 nt, Homo sapiens
cccaugggacuuuccuca

SEQ ID NO: 43085 - RNA, 21 nt, Homo sapiens
gagcugauguacaaacacagc

SEQ ID NO: 43086 - RNA, 22 nt, Homo sapiens
ggaaaucuccuucacacagcua

SEQ ID NO: 43087 - RNA, 18 nt, Homo sapiens
ucacugaccuucacuucg

SEQ ID NO: 43088 - RNA, 19 nt, Homo sapiens
ucaucaacuccuuuacauc

SEQ ID NO: 43089 - RNA, 22 nt, Homo sapiens
ugacaaaccucucuacacccca

SEQ ID NO: 43090 - RNA, 21 nt, Homo sapiens
ucuggccagaaagacauuuca

SEQ ID NO: 43091 - RNA, 21 nt, Homo sapiens
uuccagaauauacaguuccag

SEQ ID NO: 43092 - RNA, 22 nt, Homo sapiens
cuguucucuuugguuuggaaua

SEQ ID NO: 43093 - RNA, 21 nt, Homo sapiens
gccuuuccuccauuuucugug

SEQ ID NO: 43094 - RNA, 18 nt, Homo sapiens
ggagcuuuuuaaaucuca

SEQ ID NO: 43095 - RNA, 18 nt, Homo sapiens
ugagcucuuccuuagcuc

SEQ ID NO: 43096 - RNA, 21 nt, Homo sapiens
uugcccaaaacuguucucuuu

SEQ ID NO: 43097 - RNA, 18 nt, Homo sapiens
acugccaccuccaccucc

SEQ ID NO: 43098 - RNA, 22 nt, Homo sapiens
acuuggauuucugacuuggcuc

SEQ ID NO: 43099 - RNA, 22 nt, Homo sapiens
cccugauccuggggucugggga

SEQ ID NO: 43100 - RNA, 21 nt, Homo sapiens
ggguccuuguucugcugccca

SEQ ID NO: 43101 - RNA, 17 nt, Homo sapiens
acaaggugauguccccu

SEQ ID NO: 43102 - RNA, 21 nt, Homo sapiens
cagcaacccaaagagaaggga

SEQ ID NO: 43103 - RNA, 23 nt, Homo sapiens
agaauuauauuuuaaugacucca

SEQ ID NO: 43104 - RNA, 18 nt, Homo sapiens
caucaaggaaauaaauca

SEQ ID NO: 43105 - RNA, 24 nt, Homo sapiens
gcuugagcccaggcugugugguuc

SEQ ID NO: 43106 - RNA, 17 nt, Homo sapiens
uaauuguguuugugacu

SEQ ID NO: 43107 - RNA, 22 nt, Homo sapiens
ucuuuuugguguuuuaacacuu

SEQ ID NO: 43108 - RNA, 22 nt, Homo sapiens
cccggcuucccggacuccagca

SEQ ID NO: 43109 - RNA, 22 nt, Homo sapiens
ccauucugccaucuacauccca

SEQ ID NO: 43110 - RNA, 25 nt, Homo sapiens
ugaaacuucagcugcacccacacac

SEQ ID NO: 43111 - RNA, 18 nt, Homo sapiens
aauacaacaaacaaagaa

SEQ ID NO: 43112 - RNA, 19 nt, Homo sapiens
guguugguugggccuugaa

SEQ ID NO: 43113 - RNA, 21 nt, Homo sapiens
aagaccuggaacaagauucug

SEQ ID NO: 43114 - RNA, 17 nt, Homo sapiens
acgguguuugugaaggg

SEQ ID NO: 43115 - RNA, 16 nt, Homo sapiens
agacccccauucuuca

SEQ ID NO: 43116 - RNA, 21 nt, Homo sapiens
auguggcuuuuuccugacgca

SEQ ID NO: 43117 - RNA, 21 nt, Homo sapiens
ccauccucuccacagcauccc

SEQ ID NO: 43118 - RNA, 19 nt, Homo sapiens
gguguuuaaccaccuccca

SEQ ID NO: 43119 - RNA, 18 nt, Homo sapiens
guuuucuuuccccucauc

SEQ ID NO: 43120 - RNA, 18 nt, Homo sapiens
uccacuccagaguugggu

SEQ ID NO: 43121 - RNA, 17 nt, Homo sapiens
uccuguucuaucccuuc

SEQ ID NO: 43122 - RNA, 20 nt, Homo sapiens
ccagauuugcuuccuacuca

SEQ ID NO: 43123 - RNA, 23 nt, Homo sapiens
cuuugauggcaccaagaucgugg

SEQ ID NO: 43124 - RNA, 24 nt, Homo sapiens
agagaaaaguuugcgacucccaca

SEQ ID NO: 43125 - RNA, 18 nt, Homo sapiens
ggaaguggcuucuuggaa

SEQ ID NO: 43126 - RNA, 26 nt, Homo sapiens
aaggcccuguggacacuuugcaguca

SEQ ID NO: 43127 - RNA, 18 nt, Homo sapiens
aucuuaaaauguaggcuc

SEQ ID NO: 43128 - RNA, 19 nt, Homo sapiens
ccuuuuugucccuuaauuu

SEQ ID NO: 43129 - RNA, 24 nt, Homo sapiens
gugagcccagaucccgcaacugca

SEQ ID NO: 43130 - RNA, 23 nt, Homo sapiens
uuuuuucauugcuuugugacuuu

SEQ ID NO: 43131 - RNA, 19 nt, Homo sapiens
aauauuuugauuaauacua

SEQ ID NO: 43132 - RNA, 22 nt, Homo sapiens
accuggauucuaguucuggcuu

SEQ ID NO: 43133 - RNA, 21 nt, Homo sapiens
cccugaugauaagguuggugg

SEQ ID NO: 43134 - RNA, 17 nt, Homo sapiens
ccucccugcucuaguag

SEQ ID NO: 43135 - RNA, 17 nt, Homo sapiens
cuguauuacauugcuuu

SEQ ID NO: 43136 - RNA, 15 nt, Homo sapiens
gaagcucauagauau

SEQ ID NO: 43137 - RNA, 20 nt, Homo sapiens
uaauccaugcccuccucucu

SEQ ID NO: 43138 - RNA, 24 nt, Homo sapiens
ucugagcaauacggagauccuuuu

SEQ ID NO: 43139 - RNA, 23 nt, Homo sapiens
ucuuuuuguugucuuuaaacuuu

SEQ ID NO: 43140 - RNA, 18 nt, Homo sapiens
uucaaaacuaguaucuaa

SEQ ID NO: 43141 - RNA, 18 nt, Homo sapiens
uuccagacucuguuacag

SEQ ID NO: 43142 - RNA, 19 nt, Homo sapiens
aaacuccugaccucaggug

SEQ ID NO: 43143 - RNA, 19 nt, Homo sapiens
aggagcgccaagauugcca

SEQ ID NO: 43144 - RNA, 19 nt, Homo sapiens
cugcaaccuccgccuccca

SEQ ID NO: 43145 - RNA, 23 nt, Homo sapiens
gcagccuccaaggggagccuuug

SEQ ID NO: 43146 - RNA, 20 nt, Homo sapiens
gcugcagggucuggcaucag

SEQ ID NO: 43147 - RNA, 18 nt, Homo sapiens
uccgccucccagguucaa

SEQ ID NO: 43148 - RNA, 16 nt, Homo sapiens
ucuuagcggauuacuu

SEQ ID NO: 43149 - RNA, 22 nt, Homo sapiens
aggagcauggacacaggaccag

SEQ ID NO: 43150 - RNA, 22 nt, Homo sapiens
gaauacagaacagcuccuggca

SEQ ID NO: 43151 - RNA, 21 nt, Homo sapiens
gcagaggacuccagaggcuca

SEQ ID NO: 43152 - RNA, 19 nt, Homo sapiens
uucucuacuaaaaauacaa

SEQ ID NO: 43153 - RNA, 21 nt, Homo sapiens
cucuggugguuuggcuuugaa

SEQ ID NO: 43154 - RNA, 24 nt, Homo sapiens
accgcucaacuacauggaaaccga

SEQ ID NO: 43155 - RNA, 19 nt, Homo sapiens
cugcucccuucaccuuuga

SEQ ID NO: 43156 - RNA, 18 nt, Homo sapiens
uccagaaaaugaaauucc

SEQ ID NO: 43157 - RNA, 20 nt, Homo sapiens
ugcucccagagccugagcau

SEQ ID NO: 43158 - RNA, 22 nt, Homo sapiens
cccaucuuugagcccggcccca

SEQ ID NO: 43159 - RNA, 22 nt, Homo sapiens
auagucagaaaaccauaccauu

SEQ ID NO: 43160 - RNA, 22 nt, Homo sapiens
acucuggucccaacuacuuucc

SEQ ID NO: 43161 - RNA, 20 nt, Homo sapiens
agcuucaaagaggccaaaag

SEQ ID NO: 43162 - RNA, 16 nt, Homo sapiens
caaacagcauauuggc

SEQ ID NO: 43163 - RNA, 19 nt, Homo sapiens
caaccucagugucugagca

SEQ ID NO: 43164 - RNA, 18 nt, Homo sapiens
ccaauacaacuuuauuga

SEQ ID NO: 43165 - RNA, 23 nt, Homo sapiens
ccaggacacaaucugggaagcca

SEQ ID NO: 43166 - RNA, 19 nt, Homo sapiens
ggagcuuccugcaaucuca

SEQ ID NO: 43167 - RNA, 18 nt, Homo sapiens
gggccagccgugaggcua

SEQ ID NO: 43168 - RNA, 19 nt, Homo sapiens
uacuugaauacauaagcug

SEQ ID NO: 43169 - RNA, 17 nt, Homo sapiens
ucuacauucugaucaga

SEQ ID NO: 43170 - RNA, 23 nt, Homo sapiens
ugcaaauuuggucaucuacucga

SEQ ID NO: 43171 - RNA, 18 nt, Homo sapiens
ccagacggagccuccgga

SEQ ID NO: 43172 - RNA, 17 nt, Homo sapiens
ucaagugauucuucugc

SEQ ID NO: 43173 - RNA, 21 nt, Homo sapiens
aaacaugcaaacugccacuuu

SEQ ID NO: 43174 - RNA, 22 nt, Homo sapiens
aaggcaucuuuccaaguacuca

SEQ ID NO: 43175 - RNA, 18 nt, Homo sapiens
acagaagugcuuucuauu

SEQ ID NO: 43176 - RNA, 18 nt, Homo sapiens
agagccuuggaaucuacu

SEQ ID NO: 43177 - RNA, 20 nt, Homo sapiens
cagggaguuugggcuugguu

SEQ ID NO: 43178 - RNA, 20 nt, Homo sapiens
cagucuaaacuauccaguca

SEQ ID NO: 43179 - RNA, 22 nt, Homo sapiens
gguuguuuugguggucuuuuuu

SEQ ID NO: 43180 - RNA, 16 nt, Homo sapiens
ucccucagcccuuuca

SEQ ID NO: 43181 - RNA, 20 nt, Homo sapiens
uccuucccucccccaccccg

SEQ ID NO: 43182 - RNA, 18 nt, Homo sapiens
ugaaugggcuucaagugg

SEQ ID NO: 43183 - RNA, 17 nt, Homo sapiens
uggauguccuuggaaug

SEQ ID NO: 43184 - RNA, 24 nt, Homo sapiens
agucccaucaccagggagccauga

SEQ ID NO: 43185 - RNA, 20 nt, Homo sapiens
caucauccugggcacgccgu

SEQ ID NO: 43186 - RNA, 24 nt, Homo sapiens
ccagcugauugggucaggcaaguc

SEQ ID NO: 43187 - RNA, 23 nt, Homo sapiens
cccuuccagccccucuuuuccag

SEQ ID NO: 43188 - RNA, 20 nt, Homo sapiens
cucuccaacugccagcugau

SEQ ID NO: 43189 - RNA, 17 nt, Homo sapiens
gcccccuucuucuguga

SEQ ID NO: 43190 - RNA, 20 nt, Homo sapiens
guuacacagcuacaguaugu

SEQ ID NO: 43191 - RNA, 24 nt, Homo sapiens
acagagaauguguccucugcuggc

SEQ ID NO: 43192 - RNA, 21 nt, Homo sapiens
acuuuuuuuccacaacuuuuu

SEQ ID NO: 43193 - RNA, 24 nt, Homo sapiens
agucccaucaccaggcagccauga

SEQ ID NO: 43194 - RNA, 20 nt, Homo sapiens
caucauccuggacacgccgu

SEQ ID NO: 43195 - RNA, 21 nt, Homo sapiens
gaaaaggucacacccuuuuca

SEQ ID NO: 43196 - RNA, 17 nt, Homo sapiens
gcccccuucuucuguga

SEQ ID NO: 43197 - RNA, 20 nt, Homo sapiens
guuacacagcuacaguaugu

SEQ ID NO: 43198 - RNA, 20 nt, Homo sapiens
aggcugcuuggaugaccuca

SEQ ID NO: 43199 - RNA, 17 nt, Homo sapiens
aucccagcuacguggga

SEQ ID NO: 43200 - RNA, 18 nt, Homo sapiens
auuugucugaacaucaca

SEQ ID NO: 43201 - RNA, 20 nt, Homo sapiens
ccagcagcaggguuaccucc

SEQ ID NO: 43202 - RNA, 18 nt, Homo sapiens
gcccuggcagacaagcca

SEQ ID NO: 43203 - RNA, 19 nt, Homo sapiens
uggacaucagcuggggcug

SEQ ID NO: 43204 - RNA, 23 nt, Homo sapiens
ugauuggaguuccggauaugaca

SEQ ID NO: 43205 - RNA, 18 nt, Homo sapiens
aacugugggaaaauauca

SEQ ID NO: 43206 - RNA, 18 nt, Homo sapiens
accaccaccauccacucu

SEQ ID NO: 43207 - RNA, 16 nt, Homo sapiens
ggcguacacacacggg

SEQ ID NO: 43208 - RNA, 20 nt, Homo sapiens
guccuggcugggcugaguca

SEQ ID NO: 43209 - RNA, 19 nt, Homo sapiens
ccagcccccaguccccucu

SEQ ID NO: 43210 - RNA, 16 nt, Homo sapiens
augagucaccagccca

SEQ ID NO: 43211 - RNA, 18 nt, Homo sapiens
ccagcccacuuugugacc

SEQ ID NO: 43212 - RNA, 22 nt, Homo sapiens
ucuuuauccugccugugguuuu

SEQ ID NO: 43213 - RNA, 22 nt, Homo sapiens
agggacagaggacaccacuucc

SEQ ID NO: 43214 - RNA, 18 nt, Homo sapiens
ccaagccaggacucccuu

SEQ ID NO: 43215 - RNA, 21 nt, Homo sapiens
cgagauuggaaagguucauca

SEQ ID NO: 43216 - RNA, 18 nt, Homo sapiens
cuugggcuagccuggucc

SEQ ID NO: 43217 - RNA, 23 nt, Homo sapiens
caccuccauugggcccuuuuuca

SEQ ID NO: 43218 - RNA, 20 nt, Homo sapiens
cuaguggcuuugccauucaa

SEQ ID NO: 43219 - RNA, 19 nt, Homo sapiens
ugagccuucuugcuccaca

SEQ ID NO: 43220 - RNA, 22 nt, Homo sapiens
cccaaggcacagagacacgggc

SEQ ID NO: 43221 - RNA, 23 nt, Homo sapiens
cucugguggugugugcuugcgga

SEQ ID NO: 43222 - RNA, 24 nt, Homo sapiens
gcgucuuuggggacccccgugcga

SEQ ID NO: 43223 - RNA, 23 nt, Homo sapiens
cccuccccucucuuuucuugcca

SEQ ID NO: 43224 - RNA, 20 nt, Homo sapiens
cccauggcuuggcugaagcc

SEQ ID NO: 43225 - RNA, 18 nt, Homo sapiens
ucuuccuggccauggcug

SEQ ID NO: 43226 - RNA, 20 nt, Homo sapiens
agcuuuuuaaauuauuuuca

SEQ ID NO: 43227 - RNA, 20 nt, Homo sapiens
cagggacugaaccgugcugc

SEQ ID NO: 43228 - RNA, 19 nt, Homo sapiens
ugaccaugaccaugugaug

SEQ ID NO: 43229 - RNA, 22 nt, Homo sapiens
uuuaagcuuuuuaaauuauuuu

SEQ ID NO: 43230 - RNA, 26 nt, Homo sapiens
gcgucuccuccgagcuguugggcuuu

SEQ ID NO: 43231 - RNA, 19 nt, Homo sapiens
aagcaauucuccugccuca

SEQ ID NO: 43232 - RNA, 17 nt, Homo sapiens
agugcuugggugggaga

SEQ ID NO: 43233 - RNA, 21 nt, Homo sapiens
augugugauuagaaacgauga

SEQ ID NO: 43234 - RNA, 19 nt, Homo sapiens
cguccucaagagcggcugg

SEQ ID NO: 43235 - RNA, 18 nt, Homo sapiens
cugaucuuacacauauaa

SEQ ID NO: 43236 - RNA, 20 nt, Homo sapiens
uccagcagaagaugcugcuu

SEQ ID NO: 43237 - RNA, 18 nt, Homo sapiens
ugacugccaaugugugau

SEQ ID NO: 43238 - RNA, 23 nt, Homo sapiens
uugauaguguuagcauucuugga

SEQ ID NO: 43239 - RNA, 25 nt, Homo sapiens
uuuugaucacugggaagacugugaa

SEQ ID NO: 43240 - RNA, 16 nt, Homo sapiens
aaaguaaagaaaguac

SEQ ID NO: 43241 - RNA, 23 nt, Homo sapiens
auccccuagcaggugccacacag

SEQ ID NO: 43242 - RNA, 22 nt, Homo sapiens
ccauuaguaagaauuacuaaua

SEQ ID NO: 43243 - RNA, 17 nt, Homo sapiens
ucaagugauucuccugc

SEQ ID NO: 43244 - RNA, 19 nt, Homo sapiens
uuugccuguugaucucuaa

SEQ ID NO: 43245 - RNA, 21 nt, Homo sapiens
cccauggugggggucugugag

SEQ ID NO: 43246 - RNA, 23 nt, Homo sapiens
gggcuaugauugcaccacugcac

SEQ ID NO: 43247 - RNA, 16 nt, Homo sapiens
ucagcaagaaacauug

SEQ ID NO: 43248 - RNA, 23 nt, Homo sapiens
acuugcccugcauugccuggccc

SEQ ID NO: 43249 - RNA, 23 nt, Homo sapiens
ccccgccccauuuccccacgcuu

SEQ ID NO: 43250 - RNA, 19 nt, Homo sapiens
aguaguuauuauuuuugga

SEQ ID NO: 43251 - RNA, 18 nt, Homo sapiens
cggugccuuccccggugg

SEQ ID NO: 43252 - RNA, 18 nt, Homo sapiens
ucccaggcacagcugcag

SEQ ID NO: 43253 - RNA, 17 nt, Homo sapiens
agcaacccagacacuga

SEQ ID NO: 43254 - RNA, 24 nt, Homo sapiens
cacaccacccuguccagugucuug

SEQ ID NO: 43255 - RNA, 17 nt, Homo sapiens
gaaaaagaagccauuga

SEQ ID NO: 43256 - RNA, 19 nt, Homo sapiens
gcaccucccuccugccucc

SEQ ID NO: 43257 - RNA, 18 nt, Homo sapiens
ccucagcgcccagcccuu

SEQ ID NO: 43258 - RNA, 23 nt, Homo sapiens
aagcaagcauauauucucucucu

SEQ ID NO: 43259 - RNA, 27 nt, Homo sapiens
acuguuuacuaaccugugaaaauacca

SEQ ID NO: 43260 - RNA, 19 nt, Homo sapiens
aucaugaacacaauucuaa

SEQ ID NO: 43261 - RNA, 19 nt, Homo sapiens
cuaguccuucaacucacag

SEQ ID NO: 43262 - RNA, 17 nt, Homo sapiens
uacauuccuacguucuc

SEQ ID NO: 43263 - RNA, 23 nt, Homo sapiens
aaaccagggugaacccucaggug

SEQ ID NO: 43264 - RNA, 20 nt, Homo sapiens
aaccagggugaacccucagg

SEQ ID NO: 43265 - RNA, 18 nt, Homo sapiens
acagcccgcaacuuuaaa

SEQ ID NO: 43266 - RNA, 19 nt, Homo sapiens
ggaaaagcaccacaucagc

SEQ ID NO: 43267 - RNA, 18 nt, Homo sapiens
gcccugggagggcccagg

SEQ ID NO: 43268 - RNA, 21 nt, Homo sapiens
caccgaagccgccuguggaca

SEQ ID NO: 43269 - RNA, 18 nt, Homo sapiens
agaacuccaguccccuca

SEQ ID NO: 43270 - RNA, 16 nt, Homo sapiens
cccucuccacccuuca

SEQ ID NO: 43271 - RNA, 19 nt, Homo sapiens
gaaagacucagccacugga

SEQ ID NO: 43272 - RNA, 18 nt, Homo sapiens
gccaggguccagaaagac

SEQ ID NO: 43273 - RNA, 21 nt, Homo sapiens
gcccaggggaagacccaggga

SEQ ID NO: 43274 - RNA, 17 nt, Homo sapiens
gguaauuguucguggca

SEQ ID NO: 43275 - RNA, 21 nt, Homo sapiens
gcaguaucaagaagaucucca

SEQ ID NO: 43276 - RNA, 20 nt, Homo sapiens
gucucucccgaggaucuggc

SEQ ID NO: 43277 - RNA, 21 nt, Homo sapiens
caugaauuuacccaggagagu

SEQ ID NO: 43278 - RNA, 19 nt, Homo sapiens
cuucucuguccuucucccu

SEQ ID NO: 43279 - RNA, 20 nt, Homo sapiens
gaagagacagaucuccucca

SEQ ID NO: 43280 - RNA, 19 nt, Homo sapiens
ugccugggccccauuccag

SEQ ID NO: 43281 - RNA, 18 nt, Homo sapiens
uuuuuaaagcugcuuuag

SEQ ID NO: 43282 - RNA, 23 nt, Homo sapiens
accugggugcuuuccguuuguga

SEQ ID NO: 43283 - RNA, 22 nt, Homo sapiens
aucuuggcucacugcaaccucu

SEQ ID NO: 43284 - RNA, 20 nt, Homo sapiens
ccucugccuccuggguucaa

SEQ ID NO: 43285 - RNA, 22 nt, Homo sapiens
gacaugucacugagcuccccca

SEQ ID NO: 43286 - RNA, 17 nt, Homo sapiens
ucaagcgauucuugugc

SEQ ID NO: 43287 - RNA, 20 nt, Homo sapiens
caccaccacccaccgcugca

SEQ ID NO: 43288 - RNA, 19 nt, Homo sapiens
ccugagaucuuccugccca

SEQ ID NO: 43289 - RNA, 19 nt, Homo sapiens
ccuggggguggccuggucc

SEQ ID NO: 43290 - RNA, 18 nt, Homo sapiens
cuacaacaccaccaccca

SEQ ID NO: 43291 - RNA, 21 nt, Homo sapiens
gggcugagacuacaguggcca

SEQ ID NO: 43292 - RNA, 21 nt, Homo sapiens
aucuuggcucacugcaaccuc

SEQ ID NO: 43293 - RNA, 18 nt, Homo sapiens
ccugcaaccuccaccucc

SEQ ID NO: 43294 - RNA, 20 nt, Homo sapiens
gucuguucaaaaaucugaua

SEQ ID NO: 43295 - RNA, 18 nt, Homo sapiens
uccaccucccggguucaa

SEQ ID NO: 43296 - RNA, 22 nt, Homo sapiens
aucuuggcucacugcaaccucu

SEQ ID NO: 43297 - RNA, 18 nt, Homo sapiens
auucuagagaggcaucca

SEQ ID NO: 43298 - RNA, 19 nt, Homo sapiens
cugcaaccucugccuccca

SEQ ID NO: 43299 - RNA, 17 nt, Homo sapiens
uaccuaaauguaagcua

SEQ ID NO: 43300 - RNA, 17 nt, Homo sapiens
ucuuccacuuuuggugu

SEQ ID NO: 43301 - RNA, 19 nt, Homo sapiens
ugcaaggucuuccguuaua

SEQ ID NO: 43302 - RNA, 19 nt, Homo sapiens
ugcaagguguuccauuaua

SEQ ID NO: 43303 - RNA, 23 nt, Homo sapiens
uugcaaggucuuccguuauaacu

SEQ ID NO: 43304 - RNA, 18 nt, Homo sapiens
ucaugcuguugcagcagu

SEQ ID NO: 43305 - RNA, 18 nt, Homo sapiens
uguuugauuuucuggugu

SEQ ID NO: 43306 - RNA, 18 nt, Homo sapiens
gccccaaggcucugggga

SEQ ID NO: 43307 - RNA, 19 nt, Homo sapiens
gccgcucugcccccgggga

SEQ ID NO: 43308 - RNA, 23 nt, Homo sapiens
gccugagccgugaccagaggucc

SEQ ID NO: 43309 - RNA, 22 nt, Homo sapiens
gcgucugcagagcggccugcuc

SEQ ID NO: 43310 - RNA, 18 nt, Homo sapiens
ugcagagcggccugcuca

SEQ ID NO: 43311 - RNA, 23 nt, Homo sapiens
uuugucgguucugagucauuuuu

SEQ ID NO: 43312 - RNA, 21 nt, Homo sapiens
cuauccagcacgugcaccaag

SEQ ID NO: 43313 - RNA, 24 nt, Homo sapiens
cucagguccacaccaaagcuugaa

SEQ ID NO: 43314 - RNA, 27 nt, Homo sapiens
uagaugccacauuugacugugaaauua

SEQ ID NO: 43315 - RNA, 19 nt, Homo sapiens
uccaacuaugguuaacugu

SEQ ID NO: 43316 - RNA, 20 nt, Homo sapiens
ugucugcagaaagauggaga

SEQ ID NO: 43317 - RNA, 20 nt, Homo sapiens
uucugcuacuuacacuguca

SEQ ID NO: 43318 - RNA, 22 nt, Homo sapiens
aauugauauuagauuugucuca

SEQ ID NO: 43319 - RNA, 23 nt, Homo sapiens
ucuuuuuaaacaguucugaccuu

SEQ ID NO: 43320 - RNA, 18 nt, Homo sapiens
uuucagaaacagaacaaa

SEQ ID NO: 43321 - RNA, 19 nt, Homo sapiens
aaaacacagagucaguguu

SEQ ID NO: 43322 - RNA, 20 nt, Homo sapiens
acacagagucaguguuaaau

SEQ ID NO: 43323 - RNA, 18 nt, Homo sapiens
auacccaguuucacagca

SEQ ID NO: 43324 - RNA, 19 nt, Homo sapiens
augaucuacaagagacuca

SEQ ID NO: 43325 - RNA, 18 nt, Homo sapiens
auguuuuugugguaaaau

SEQ ID NO: 43326 - RNA, 23 nt, Homo sapiens
caucuuaaccugagucccucuca

SEQ ID NO: 43327 - RNA, 18 nt, Homo sapiens
ccguggacauguuguuca

SEQ ID NO: 43328 - RNA, 17 nt, Homo sapiens
cugcugaucuguuuugu

SEQ ID NO: 43329 - RNA, 22 nt, Homo sapiens
cuuuuucaagauugcuuuggcu

SEQ ID NO: 43330 - RNA, 22 nt, Homo sapiens
guauaucuguuacagcuaguug

SEQ ID NO: 43331 - RNA, 19 nt, Homo sapiens
uaaguuuuguuauguugua

SEQ ID NO: 43332 - RNA, 18 nt, Homo sapiens
uaauccaugaauauacuu

SEQ ID NO: 43333 - RNA, 17 nt, Homo sapiens
ucaaaucaagauucuuu

SEQ ID NO: 43334 - RNA, 18 nt, Homo sapiens
uccaacuauuacuguaga

SEQ ID NO: 43335 - RNA, 25 nt, Homo sapiens
uccauagaaauauuucaauuccucu

SEQ ID NO: 43336 - RNA, 23 nt, Homo sapiens
ucuaguaaguguguuuuaacuuu

SEQ ID NO: 43337 - RNA, 17 nt, Homo sapiens
ucuccccauccccaggg

SEQ ID NO: 43338 - RNA, 17 nt, Homo sapiens
ugugauuggcuuaguua

SEQ ID NO: 43339 - RNA, 16 nt, Homo sapiens
uguuacagcuaguuga

SEQ ID NO: 43340 - RNA, 21 nt, Homo sapiens
uugguaugagagucuuaggga

SEQ ID NO: 43341 - RNA, 19 nt, Homo sapiens
ugccuccaucuccauacca

SEQ ID NO: 43342 - RNA, 16 nt, Homo sapiens
gguuccgugggcagcc

SEQ ID NO: 43343 - RNA, 19 nt, Homo sapiens
gguugggggcaaugaugaa

SEQ ID NO: 43344 - RNA, 24 nt, Homo sapiens
uccagaccccgguaaaucccauca

SEQ ID NO: 43345 - RNA, 17 nt, Homo sapiens
uggucucggauuccuga

SEQ ID NO: 43346 - RNA, 19 nt, Homo sapiens
agaagaacaaagcugcaga

SEQ ID NO: 43347 - RNA, 18 nt, Homo sapiens
ugucaccaaugucuguga

SEQ ID NO: 43348 - RNA, 18 nt, Homo sapiens
ucuuuccccaaacaccua

SEQ ID NO: 43349 - RNA, 24 nt, Homo sapiens
ugaguggguucuggcugcuggcug

SEQ ID NO: 43350 - RNA, 21 nt, Homo sapiens
uuucuuuauaggcaauggccu

SEQ ID NO: 43351 - RNA, 21 nt, Homo sapiens
uuuggcuccucccccacccca

SEQ ID NO: 43352 - RNA, 21 nt, Homo sapiens
aucuugguucacugcaaccuc

SEQ ID NO: 43353 - RNA, 18 nt, Homo sapiens
ccugcaaccuccaccucc

SEQ ID NO: 43354 - RNA, 19 nt, Homo sapiens
cugcaaccuccaccuccca

SEQ ID NO: 43355 - RNA, 23 nt, Homo sapiens
gcagguggaggccaugucauuuc

SEQ ID NO: 43356 - RNA, 17 nt, Homo sapiens
ucaagugauucuccugc

SEQ ID NO: 43357 - RNA, 18 nt, Homo sapiens
uccaccucccagguucaa

SEQ ID NO: 43358 - RNA, 17 nt, Homo sapiens
uucccagccucaugaaa

SEQ ID NO: 43359 - RNA, 19 nt, Homo sapiens
aaacacauaucaagaucca

SEQ ID NO: 43360 - RNA, 17 nt, Homo sapiens
gcaaccucagccaauga

SEQ ID NO: 43361 - RNA, 23 nt, Homo sapiens
aaguauuuauuguguauuugaua

SEQ ID NO: 43362 - RNA, 24 nt, Homo sapiens
gccucaauauuuaacaacaagcca

SEQ ID NO: 43363 - RNA, 22 nt, Homo sapiens
gcuguauguauguuuuguuuua

SEQ ID NO: 43364 - RNA, 21 nt, Homo sapiens
ucaauauuuaacaacaagcca

SEQ ID NO: 43365 - RNA, 23 nt, Homo sapiens
uucagcacuaaugacugcuccag

SEQ ID NO: 43366 - RNA, 18 nt, Homo sapiens
acagcgggaggccuggga

SEQ ID NO: 43367 - RNA, 19 nt, Homo sapiens
cacaguggacacgagcuga

SEQ ID NO: 43368 - RNA, 18 nt, Homo sapiens
ugggugggcuuggugggg

SEQ ID NO: 43369 - RNA, 17 nt, Homo sapiens
uuagccccccuccaccu

SEQ ID NO: 43370 - RNA, 23 nt, Homo sapiens
aagggguuucuaacaaaugaaga

SEQ ID NO: 43371 - RNA, 19 nt, Homo sapiens
acccaaaugucacccccca

SEQ ID NO: 43372 - RNA, 20 nt, Homo sapiens
caacagggcccucugcuccu

SEQ ID NO: 43373 - RNA, 19 nt, Homo sapiens
ccaaguauuucuccauguc

SEQ ID NO: 43374 - RNA, 24 nt, Homo sapiens
ccauuguuacaacccaaaugucac

SEQ ID NO: 43375 - RNA, 20 nt, Homo sapiens
gacagggagaggccacuccu

SEQ ID NO: 43376 - RNA, 19 nt, Homo sapiens
ggacagcuucacuuccucu

SEQ ID NO: 43377 - RNA, 19 nt, Homo sapiens
ggcuguccccugccuuucc

SEQ ID NO: 43378 - RNA, 23 nt, Homo sapiens
ugcccugagcuccacauucuccu

SEQ ID NO: 43379 - RNA, 19 nt, Homo sapiens
uggcaugaaaucugugaau

SEQ ID NO: 43380 - RNA, 19 nt, Homo sapiens
ccacccccuccuuugggga

SEQ ID NO: 43381 - RNA, 22 nt, Homo sapiens
cucucucucuuucucugccuca

SEQ ID NO: 43382 - RNA, 18 nt, Homo sapiens
cuuagacuuuaucccaaa

SEQ ID NO: 43383 - RNA, 20 nt, Homo sapiens
agaauaagaaagcagccagc

SEQ ID NO: 43384 - RNA, 20 nt, Homo sapiens
aggccuuucccaacaugcca

SEQ ID NO: 43385 - RNA, 17 nt, Homo sapiens
cagcuaagauuaugcca

SEQ ID NO: 43386 - RNA, 22 nt, Homo sapiens
guaggaaaagagggucuuguca

SEQ ID NO: 43387 - RNA, 22 nt, Homo sapiens
gucauacccuacuaaacaccca

SEQ ID NO: 43388 - RNA, 18 nt, Homo sapiens
uacccuacuaaacaccca

SEQ ID NO: 43389 - RNA, 19 nt, Homo sapiens
caagagggcgcgggagcua

SEQ ID NO: 43390 - RNA, 19 nt, Homo sapiens
ccacagcccgcuucccgca

SEQ ID NO: 43391 - RNA, 20 nt, Homo sapiens
uucaagaccagccugaccaa

SEQ ID NO: 43392 - RNA, 22 nt, Homo sapiens
uucuccgggggggacuugcgga

SEQ ID NO: 43393 - RNA, 21 nt, Homo sapiens
aaccacugugccucucacaca

SEQ ID NO: 43394 - RNA, 21 nt, Homo sapiens
cuguuuugcagcagaucucca

SEQ ID NO: 43395 - RNA, 18 nt, Homo sapiens
gccucuuccacccaccca

SEQ ID NO: 43396 - RNA, 21 nt, Homo sapiens
uucccucaguuccugcugcca

SEQ ID NO: 43397 - RNA, 16 nt, Homo sapiens
uugaaagcuaaaggca

SEQ ID NO: 43398 - RNA, 19 nt, Homo sapiens
aagcaauucuccugccuca

SEQ ID NO: 43399 - RNA, 19 nt, Homo sapiens
auuccaagaccucgggcug

SEQ ID NO: 43400 - RNA, 18 nt, Homo sapiens
auuggcaaucugugauca

SEQ ID NO: 43401 - RNA, 20 nt, Homo sapiens
cccauuacauguuaucauag

SEQ ID NO: 43402 - RNA, 19 nt, Homo sapiens
cugcaaccuccgccuccca

SEQ ID NO: 43403 - RNA, 24 nt, Homo sapiens
gacugacauuccuggaaaauauca

SEQ ID NO: 43404 - RNA, 19 nt, Homo sapiens
gugaaugugugugugugug

SEQ ID NO: 43405 - RNA, 18 nt, Homo sapiens
uccgccucccagguucaa

SEQ ID NO: 43406 - RNA, 22 nt, Homo sapiens
cagccuggccaacacagugaaa

SEQ ID NO: 43407 - RNA, 24 nt, Homo sapiens
gccugggcugugugguucugggcc

SEQ ID NO: 43408 - RNA, 17 nt, Homo sapiens
ggccgggugcacuggcu

SEQ ID NO: 43409 - RNA, 19 nt, Homo sapiens
ucccuaccaugccucugca

SEQ ID NO: 43410 - RNA, 19 nt, Homo sapiens
acuccaggaguucuuggga

SEQ ID NO: 43411 - RNA, 20 nt, Homo sapiens
aucacaguugucugaccuga

SEQ ID NO: 43412 - RNA, 21 nt, Homo sapiens
uacagcgugccuuggcacugg

SEQ ID NO: 43413 - RNA, 18 nt, Homo sapiens
caaacaggcauuuuugca

SEQ ID NO: 43414 - RNA, 21 nt, Homo sapiens
ugcagcuacaaggccacuggc

SEQ ID NO: 43415 - RNA, 18 nt, Homo sapiens
uggguggaucaccugagg

SEQ ID NO: 43416 - RNA, 20 nt, Homo sapiens
acaaccaccugcuccaacac

SEQ ID NO: 43417 - RNA, 19 nt, Homo sapiens
acguacagaauguuccaca

SEQ ID NO: 43418 - RNA, 19 nt, Homo sapiens
cgucccuuccagcacccca

SEQ ID NO: 43419 - RNA, 19 nt, Homo sapiens
cagugucuguggcaauaug

SEQ ID NO: 43420 - RNA, 23 nt, Homo sapiens
ucuuuaaagacccuguuuccaaa

SEQ ID NO: 43421 - RNA, 18 nt, Homo sapiens
caauacaguacaauuaua

SEQ ID NO: 43422 - RNA, 23 nt, Homo sapiens
aagcaagcauauauucucucucu

SEQ ID NO: 43423 - RNA, 27 nt, Homo sapiens
acuguuuacuaaccugugaaaauacca

SEQ ID NO: 43424 - RNA, 16 nt, Homo sapiens
agaaaacgaaacaaac

SEQ ID NO: 43425 - RNA, 19 nt, Homo sapiens
aucaugaacacaauucuaa

SEQ ID NO: 43426 - RNA, 19 nt, Homo sapiens
cuaguccuucaacucacag

SEQ ID NO: 43427 - RNA, 17 nt, Homo sapiens
uacauuccuacguucuc

SEQ ID NO: 43428 - RNA, 20 nt, Homo sapiens
uuuccauucacauauuacaa

SEQ ID NO: 43429 - RNA, 19 nt, Homo sapiens
aaagaggggagcccugugu

SEQ ID NO: 43430 - RNA, 17 nt, Homo sapiens
cagccaagguccaucau

SEQ ID NO: 43431 - RNA, 17 nt, Homo sapiens
gcuucugagccauuuug

SEQ ID NO: 43432 - RNA, 23 nt, Homo sapiens
ugcgcuguuucugcuuauguggu

SEQ ID NO: 43433 - RNA, 18 nt, Homo sapiens
agaaaaauuuuugauggu

SEQ ID NO: 43434 - RNA, 23 nt, Homo sapiens
aaacaaugugauagaauauccag

SEQ ID NO: 43435 - RNA, 17 nt, Homo sapiens
accaccaacaacuguuc

SEQ ID NO: 43436 - RNA, 18 nt, Homo sapiens
caacaacuguucguacug

SEQ ID NO: 43437 - RNA, 22 nt, Homo sapiens
ccacccuuuucaaccaccaaca

SEQ ID NO: 43438 - RNA, 18 nt, Homo sapiens
gaaaaaacaagucacuua

SEQ ID NO: 43439 - RNA, 17 nt, Homo sapiens
gccuuggcuccuggcuu

SEQ ID NO: 43440 - RNA, 18 nt, Homo sapiens
gugguucucaaacuuuag

SEQ ID NO: 43441 - RNA, 21 nt, Homo sapiens
uuuccaacuucuaccuuuaag

SEQ ID NO: 43442 - RNA, 19 nt, Homo sapiens
aagguuacucaaccuguaa

SEQ ID NO: 43443 - RNA, 24 nt, Homo sapiens
auguuuucugguuguuuuagucuu

SEQ ID NO: 43444 - RNA, 19 nt, Homo sapiens
auuacucugcgguacacua

SEQ ID NO: 43445 - RNA, 25 nt, Homo sapiens
aaaagaaagaaauugccuuauguca

SEQ ID NO: 43446 - RNA, 17 nt, Homo sapiens
ccuucuuccccuuaucc

SEQ ID NO: 43447 - RNA, 18 nt, Homo sapiens
cucuccuuuggauaucug

SEQ ID NO: 43448 - RNA, 17 nt, Homo sapiens
cugcauggugcuuuguc

SEQ ID NO: 43449 - RNA, 20 nt, Homo sapiens
cugccugccugccugccuca

SEQ ID NO: 43450 - RNA, 20 nt, Homo sapiens
uccuccuuuccccucuccuu

SEQ ID NO: 43451 - RNA, 19 nt, Homo sapiens
aagcaauucuccugccuca

SEQ ID NO: 43452 - RNA, 19 nt, Homo sapiens
auacaacuuacccucauca

SEQ ID NO: 43453 - RNA, 20 nt, Homo sapiens
aucauggaggcagguauuuc

SEQ ID NO: 43454 - RNA, 21 nt, Homo sapiens
cagcaauguagaacuguaagu

SEQ ID NO: 43455 - RNA, 22 nt, Homo sapiens
cagugguauagucugcauauga

SEQ ID NO: 43456 - RNA, 20 nt, Homo sapiens
ccucugccucccagguucaa

SEQ ID NO: 43457 - RNA, 21 nt, Homo sapiens
ccuuuuuacagcuuuugacuu

SEQ ID NO: 43458 - RNA, 23 nt, Homo sapiens
cugcagaagcucuaucuuugauu

SEQ ID NO: 43459 - RNA, 19 nt, Homo sapiens
cugcuuuugcuguauccca

SEQ ID NO: 43460 - RNA, 21 nt, Homo sapiens
gaauuauugugcuucuuugga

SEQ ID NO: 43461 - RNA, 20 nt, Homo sapiens
gccucuaaugauccuuuuua

SEQ ID NO: 43462 - RNA, 21 nt, Homo sapiens
ggcguuuccucaggccucuca

SEQ ID NO: 43463 - RNA, 24 nt, Homo sapiens
ggucugaugguuuugaaaagggua

SEQ ID NO: 43464 - RNA, 24 nt, Homo sapiens
gugucugaacuaccagugaguuuu

SEQ ID NO: 43465 - RNA, 20 nt, Homo sapiens
guucuuuugcuucccaaugu

SEQ ID NO: 43466 - RNA, 19 nt, Homo sapiens
ucacugacagcuugcacug

SEQ ID NO: 43467 - RNA, 19 nt, Homo sapiens
uugucuuuugacaauuuua

SEQ ID NO: 43468 - RNA, 23 nt, Homo sapiens
uuuagcuacuccugauuauuuuu

SEQ ID NO: 43469 - RNA, 20 nt, Homo sapiens
uuuugggagacuuuuuguua

SEQ ID NO: 43470 - RNA, 24 nt, Homo sapiens
gagacauaacgauuuggauugcua

SEQ ID NO: 43471 - RNA, 18 nt, Homo sapiens
ggaagccaaggaccagcu

SEQ ID NO: 43472 - RNA, 21 nt, Homo sapiens
guuuucuugcuccuguggaug

SEQ ID NO: 43473 - RNA, 21 nt, Homo sapiens
uaaaccagggacacaaugcac

SEQ ID NO: 43474 - RNA, 18 nt, Homo sapiens
uguuggcaguaaugcugc

SEQ ID NO: 43475 - RNA, 19 nt, Homo sapiens
ggccggguguuggauacca

SEQ ID NO: 43476 - RNA, 19 nt, Homo sapiens
aaacacauaucaagaucca

SEQ ID NO: 43477 - RNA, 19 nt, Homo sapiens
ccccagcaaccucagccaa

SEQ ID NO: 43478 - RNA, 17 nt, Homo sapiens
gcaaccucagccaauga

SEQ ID NO: 43479 - RNA, 21 nt, Homo sapiens
ugggugggccucacccugcug

SEQ ID NO: 43480 - RNA, 24 nt, Homo sapiens
aggauaauuugcauauccaucacc

SEQ ID NO: 43481 - RNA, 18 nt, Homo sapiens
aguauugcauaacuuuaa

SEQ ID NO: 43482 - RNA, 19 nt, Homo sapiens
auccuggugguaggucucu

SEQ ID NO: 43483 - RNA, 20 nt, Homo sapiens
caaaggauauaaaugacuaa

SEQ ID NO: 43484 - RNA, 18 nt, Homo sapiens
ccugagccugcauggccu

SEQ ID NO: 43485 - RNA, 22 nt, Homo sapiens
gacaagccugagcaacauauca

SEQ ID NO: 43486 - RNA, 19 nt, Homo sapiens
gacgcaggcgccauugcac

SEQ ID NO: 43487 - RNA, 18 nt, Homo sapiens
gccauaucacugagggua

SEQ ID NO: 43488 - RNA, 16 nt, Homo sapiens
gcugggcacucaggga

SEQ ID NO: 43489 - RNA, 17 nt, Homo sapiens
ggaucaggcagcuccaa

SEQ ID NO: 43490 - RNA, 18 nt, Homo sapiens
uuacaccuucuuucugua

SEQ ID NO: 43491 - RNA, 20 nt, Homo sapiens
uuauacauauuuguagggua

SEQ ID NO: 43492 - RNA, 18 nt, Homo sapiens
aaauguagaccuccauga

SEQ ID NO: 43493 - RNA, 18 nt, Homo sapiens
aauauacugguauagcuu

SEQ ID NO: 43494 - RNA, 18 nt, Homo sapiens
auuggaugacccuggaca

SEQ ID NO: 43495 - RNA, 18 nt, Homo sapiens
ccccacaagaagcaccuc

SEQ ID NO: 43496 - RNA, 21 nt, Homo sapiens
gcuuagaaccaguaugcccaa

SEQ ID NO: 43497 - RNA, 20 nt, Homo sapiens
ucagcaggaggcacugugaa

SEQ ID NO: 43498 - RNA, 18 nt, Homo sapiens
uguaaauagauggucccg

SEQ ID NO: 43499 - RNA, 22 nt, Homo sapiens
accucaccgugcaggaauccca

SEQ ID NO: 43500 - RNA, 21 nt, Homo sapiens
aggaccuaggaaaauaccaga

SEQ ID NO: 43501 - RNA, 24 nt, Homo sapiens
cagguguggggcuggguaugguca

SEQ ID NO: 43502 - RNA, 22 nt, Homo sapiens
ucaaugccaaggccacguucaa

SEQ ID NO: 43503 - RNA, 20 nt, Homo sapiens
ugggagcccaucacacaucc

SEQ ID NO: 43504 - RNA, 24 nt, Homo sapiens
aggauaauuugcauauccaucacc

SEQ ID NO: 43505 - RNA, 18 nt, Homo sapiens
aguauugcauaacuuuaa

SEQ ID NO: 43506 - RNA, 19 nt, Homo sapiens
auccuggugguaggucucu

SEQ ID NO: 43507 - RNA, 20 nt, Homo sapiens
caaaggauauaaaugacuaa

SEQ ID NO: 43508 - RNA, 18 nt, Homo sapiens
ccugagccugcauggccu

SEQ ID NO: 43509 - RNA, 22 nt, Homo sapiens
gacaagccugagcaacauauca

SEQ ID NO: 43510 - RNA, 19 nt, Homo sapiens
gacgcaggcgccauugcac

SEQ ID NO: 43511 - RNA, 18 nt, Homo sapiens
gccauaucacugagggua

SEQ ID NO: 43512 - RNA, 16 nt, Homo sapiens
gcugggcacucaggga

SEQ ID NO: 43513 - RNA, 17 nt, Homo sapiens
ggaucaggcagcuccaa

SEQ ID NO: 43514 - RNA, 18 nt, Homo sapiens
uuacaccuucuuucugua

SEQ ID NO: 43515 - RNA, 20 nt, Homo sapiens
uuauacauauuuguagggua

SEQ ID NO: 43516 - RNA, 24 nt, Homo sapiens
aaugugacaauauuuucaucaccg

SEQ ID NO: 43517 - RNA, 21 nt, Homo sapiens
ccacagcccguggucccccuc

SEQ ID NO: 43518 - RNA, 21 nt, Homo sapiens
ccauccgugaccgcguggccu

SEQ ID NO: 43519 - RNA, 18 nt, Homo sapiens
ccccgcagccccugcagc

SEQ ID NO: 43520 - RNA, 16 nt, Homo sapiens
cucagcugaagccccu

SEQ ID NO: 43521 - RNA, 20 nt, Homo sapiens
cugcaagacgcgccgccuca

SEQ ID NO: 43522 - RNA, 18 nt, Homo sapiens
gagcgugaugcuuggcuc

SEQ ID NO: 43523 - RNA, 16 nt, Homo sapiens
gauccugaaaucaagg

SEQ ID NO: 43524 - RNA, 20 nt, Homo sapiens
ccacugccucccagguucaa

SEQ ID NO: 43525 - RNA, 16 nt, Homo sapiens
gucaaggaggguaagu

SEQ ID NO: 43526 - RNA, 23 nt, Homo sapiens
uagggaggucaauuguggggcua

SEQ ID NO: 43527 - RNA, 20 nt, Homo sapiens
ucggcagaucugaauuuucu

SEQ ID NO: 43528 - RNA, 18 nt, Homo sapiens
acuuccugucucugugac

SEQ ID NO: 43529 - RNA, 20 nt, Homo sapiens
agucucacucuguugcccag

SEQ ID NO: 43530 - RNA, 18 nt, Homo sapiens
aguuugacauggcucacu

SEQ ID NO: 43531 - RNA, 23 nt, Homo sapiens
caaugccuagaacaaauaagcaa

SEQ ID NO: 43532 - RNA, 18 nt, Homo sapiens
cagcacuuugggaagcca

SEQ ID NO: 43533 - RNA, 20 nt, Homo sapiens
ccuacagaacggcaguuuga

SEQ ID NO: 43534 - RNA, 19 nt, Homo sapiens
cugcaaccuccgccuccca

SEQ ID NO: 43535 - RNA, 23 nt, Homo sapiens
ggaccgugaauuaacaguggcca

SEQ ID NO: 43536 - RNA, 19 nt, Homo sapiens
ggccaaccauuuaaccuca

SEQ ID NO: 43537 - RNA, 20 nt, Homo sapiens
guugaaccccaggucugccu

SEQ ID NO: 43538 - RNA, 18 nt, Homo sapiens
uccgccucccagguucaa

SEQ ID NO: 43539 - RNA, 21 nt, Homo sapiens
ugccucgauuucuucaucucu

SEQ ID NO: 43540 - RNA, 20 nt, Homo sapiens
ccuccuguccucagggauca

SEQ ID NO: 43541 - RNA, 18 nt, Homo sapiens
cuacaggcugggguggcc

SEQ ID NO: 43542 - RNA, 22 nt, Homo sapiens
gaaaaccaaccccacccugcca

SEQ ID NO: 43543 - RNA, 19 nt, Homo sapiens
gggacugcugguugccaac

SEQ ID NO: 43544 - RNA, 17 nt, Homo sapiens
uagcacagugcuuggca

SEQ ID NO: 43545 - RNA, 20 nt, Homo sapiens
aacagucucacuucauucuu

SEQ ID NO: 43546 - RNA, 18 nt, Homo sapiens
agcaauucuccugucuua

SEQ ID NO: 43547 - RNA, 19 nt, Homo sapiens
aggagaugggaagaagcaa

SEQ ID NO: 43548 - RNA, 23 nt, Homo sapiens
auuugaaccuguguucuugguuc

SEQ ID NO: 43549 - RNA, 16 nt, Homo sapiens
cauucccacuuggcuu

SEQ ID NO: 43550 - RNA, 19 nt, Homo sapiens
ccauaauauacacacucua

SEQ ID NO: 43551 - RNA, 20 nt, Homo sapiens
ccucugccucccggguucaa

SEQ ID NO: 43552 - RNA, 17 nt, Homo sapiens
cggcaaccucugccucc

SEQ ID NO: 43553 - RNA, 22 nt, Homo sapiens
gaaccaagaucaugccacugca

SEQ ID NO: 43554 - RNA, 23 nt, Homo sapiens
gcgugaacaagccagucccgcua

SEQ ID NO: 43555 - RNA, 28 nt, Homo sapiens
ggccgucccagaagcgccugcucccccu

SEQ ID NO: 43556 - RNA, 19 nt, Homo sapiens
guuuucuugccagccauga

SEQ ID NO: 43557 - RNA, 22 nt, Homo sapiens
uaugggagagaagaagcuauga

SEQ ID NO: 43558 - RNA, 18 nt, Homo sapiens
ucucaccucuucuucagg

SEQ ID NO: 43559 - RNA, 20 nt, Homo sapiens
ugagcaccaacaugacacua

SEQ ID NO: 43560 - RNA, 22 nt, Homo sapiens
ugguguuuuccccaggcugcua

SEQ ID NO: 43561 - RNA, 15 nt, Homo sapiens
uuagccuccauguuu

SEQ ID NO: 43562 - RNA, 20 nt, Homo sapiens
uuccugugccaggcccugga

SEQ ID NO: 43563 - RNA, 21 nt, Homo sapiens
aagacaugcaguuaaacuuga

SEQ ID NO: 43564 - RNA, 27 nt, Homo sapiens
aagugacuaagggcaauaacucauuaa

SEQ ID NO: 43565 - RNA, 19 nt, Homo sapiens
auuguaaacaugugcuuca

SEQ ID NO: 43566 - RNA, 20 nt, Homo sapiens
uaguguuauuuauggauuag

SEQ ID NO: 43567 - RNA, 26 nt, Homo sapiens
auggacccagguccugaaugaagcug

SEQ ID NO: 43568 - RNA, 21 nt, Homo sapiens
cccuccccaccucuucucucc

SEQ ID NO: 43569 - RNA, 17 nt, Homo sapiens
cuccccagucuucucca

SEQ ID NO: 43570 - RNA, 21 nt, Homo sapiens
cugguccccccaacagaucuc

SEQ ID NO: 43571 - RNA, 17 nt, Homo sapiens
cuucucuaccuccccuc

SEQ ID NO: 43572 - RNA, 24 nt, Homo sapiens
gcccaaggguagggaaucugggga

SEQ ID NO: 43573 - RNA, 21 nt, Homo sapiens
uccagggacagagugauccaa

SEQ ID NO: 43574 - RNA, 17 nt, Homo sapiens
ugcugauugcaugugug

SEQ ID NO: 43575 - RNA, 23 nt, Homo sapiens
gcucuggggaggagaggcuggga

SEQ ID NO: 43576 - RNA, 21 nt, Homo sapiens
acccguggagcgcacauucug

SEQ ID NO: 43577 - RNA, 21 nt, Homo sapiens
gaagaggcaaaugacauuuca

SEQ ID NO: 43578 - RNA, 22 nt, Homo sapiens
accuggcccaucgccguggccu

SEQ ID NO: 43579 - RNA, 18 nt, Homo sapiens
cccuggaggccuugggga

SEQ ID NO: 43580 - RNA, 18 nt, Homo sapiens
ccuuggggauucggagga

SEQ ID NO: 43581 - RNA, 19 nt, Homo sapiens
gcccuggaggccuugggga

SEQ ID NO: 43582 - RNA, 20 nt, Homo sapiens
ccagagcuggaguccaccuu

SEQ ID NO: 43583 - RNA, 18 nt, Homo sapiens
ccccagccagaaaaucca

SEQ ID NO: 43584 - RNA, 25 nt, Homo sapiens
uuuugacgugucuuggagccugugg

SEQ ID NO: 43585 - RNA, 17 nt, Homo sapiens
gccugcuccaucaggga

SEQ ID NO: 43586 - RNA, 21 nt, Homo sapiens
gcuccccugaggaucccagga

SEQ ID NO: 43587 - RNA, 20 nt, Homo sapiens
aaccaaaaggauuggguuug

SEQ ID NO: 43588 - RNA, 15 nt, Homo sapiens
augauguaaucaguu

SEQ ID NO: 43589 - RNA, 19 nt, Homo sapiens
gacacugggcugucugcuu

SEQ ID NO: 43590 - RNA, 18 nt, Homo sapiens
uaaucagugaaucauaga

SEQ ID NO: 43591 - RNA, 20 nt, Homo sapiens
uggaauuaauuaugagacug

SEQ ID NO: 43592 - RNA, 19 nt, Homo sapiens
ugugguggacagauauaga

SEQ ID NO: 43593 - RNA, 18 nt, Homo sapiens
caucgggaagccccuggg

SEQ ID NO: 43594 - RNA, 19 nt, Homo sapiens
gcccuuccuccaggcuucu

SEQ ID NO: 43595 - RNA, 22 nt, Homo sapiens
uguccucaaguuguuccugcua

SEQ ID NO: 43596 - RNA, 20 nt, Homo sapiens
uucagaaccccuagagcaau

SEQ ID NO: 43597 - RNA, 15 nt, Homo sapiens
cuguuauuuuugcug

SEQ ID NO: 43598 - RNA, 19 nt, Homo sapiens
gcccagaucagcuguccag

SEQ ID NO: 43599 - RNA, 22 nt, Homo sapiens
aaaacuggcugcggugagcucu

SEQ ID NO: 43600 - RNA, 22 nt, Homo sapiens
acaugcccacccucuuaucuca

SEQ ID NO: 43601 - RNA, 22 nt, Homo sapiens
agaagccccucacagcccagga

SEQ ID NO: 43602 - RNA, 19 nt, Homo sapiens
ccaccucccgggccccccu

SEQ ID NO: 43603 - RNA, 20 nt, Homo sapiens
ccccagaagccccucacagc

SEQ ID NO: 43604 - RNA, 22 nt, Homo sapiens
ggcguacacguagaggcaugug

SEQ ID NO: 43605 - RNA, 19 nt, Homo sapiens
ccaugggaacaaccccguc

SEQ ID NO: 43606 - RNA, 18 nt, Homo sapiens
ccguccucacacacgaca

SEQ ID NO: 43607 - RNA, 19 nt, Homo sapiens
ccacagcagcuccacuuuu

SEQ ID NO: 43608 - RNA, 20 nt, Homo sapiens
caauggccaucccugcuccu

SEQ ID NO: 43609 - RNA, 22 nt, Homo sapiens
auccuuccagaaauuaccuauc

SEQ ID NO: 43610 - RNA, 18 nt, Homo sapiens
auuccuggggcccuggca

SEQ ID NO: 43611 - RNA, 20 nt, Homo sapiens
uccugguuuggcgcuuugug

SEQ ID NO: 43612 - RNA, 20 nt, Homo sapiens
gaccaggcacagaaagcuga

SEQ ID NO: 43613 - RNA, 18 nt, Homo sapiens
agagccagacagaggaga

SEQ ID NO: 43614 - RNA, 21 nt, Homo sapiens
ucucugacaccacucuggaga

SEQ ID NO: 43615 - RNA, 15 nt, Homo sapiens
agccuagucuccuca

SEQ ID NO: 43616 - RNA, 23 nt, Homo sapiens
uacugcagugaaugagcuucuga

SEQ ID NO: 43617 - RNA, 18 nt, Homo sapiens
ggagcuuuuuaaaucuca

SEQ ID NO: 43618 - RNA, 18 nt, Homo sapiens
ugagcucuucauuagcuc

SEQ ID NO: 43619 - RNA, 20 nt, Homo sapiens
aagacaccugucaaauguca

SEQ ID NO: 43620 - RNA, 22 nt, Homo sapiens
acucgccucugcuccugugguc

SEQ ID NO: 43621 - RNA, 17 nt, Homo sapiens
acugugcucagauuccc

SEQ ID NO: 43622 - RNA, 17 nt, Homo sapiens
cccccugggauggcuca

SEQ ID NO: 43623 - RNA, 21 nt, Homo sapiens
ggccccucucugggcagucag

SEQ ID NO: 43624 - RNA, 17 nt, Homo sapiens
ugcuagcagcugugaug

SEQ ID NO: 43625 - RNA, 19 nt, Homo sapiens
agacccacuaauuugcaca

SEQ ID NO: 43626 - RNA, 20 nt, Homo sapiens
caugacaaccccacuguaca

SEQ ID NO: 43627 - RNA, 18 nt, Homo sapiens
ggagcuuuuuaaaucuca

SEQ ID NO: 43628 - RNA, 18 nt, Homo sapiens
ugagcucuucauuagcuc

SEQ ID NO: 43629 - RNA, 19 nt, Homo sapiens
aaacuugucaggacuggcu

SEQ ID NO: 43630 - RNA, 19 nt, Homo sapiens
aauuccuuuagauguuauc

SEQ ID NO: 43631 - RNA, 24 nt, Homo sapiens
agaaagauaaccuuaaccaggaca

SEQ ID NO: 43632 - RNA, 21 nt, Homo sapiens
cauuaugauggugguagaagc

SEQ ID NO: 43633 - RNA, 20 nt, Homo sapiens
ccuccucggcuuccuccuca

SEQ ID NO: 43634 - RNA, 21 nt, Homo sapiens
cuccuccuccuccuccuccuc

SEQ ID NO: 43635 - RNA, 21 nt, Homo sapiens
gggccguaugggaagcugcac

SEQ ID NO: 43636 - RNA, 18 nt, Homo sapiens
uuuuucuauaccaaucgc

SEQ ID NO: 43637 - RNA, 22 nt, Homo sapiens
cccuuccagggccucugcucca

SEQ ID NO: 43638 - RNA, 19 nt, Homo sapiens
uuccagggccucugcucca

SEQ ID NO: 43639 - RNA, 23 nt, Homo sapiens
ccuuaguugcuggcuuugaccuu

SEQ ID NO: 43640 - RNA, 22 nt, Homo sapiens
cuguaaugauuagucuguaugu

SEQ ID NO: 43641 - RNA, 22 nt, Homo sapiens
accagagaacaaauucuggcca

SEQ ID NO: 43642 - RNA, 20 nt, Homo sapiens
cucuccccagagcauuugau

SEQ ID NO: 43643 - RNA, 21 nt, Homo sapiens
ggacaaaaagugaaauacuuu

SEQ ID NO: 43644 - RNA, 19 nt, Homo sapiens
ugaguggguuccggagagc

SEQ ID NO: 43645 - RNA, 17 nt, Homo sapiens
aaacccagcccaaacau

SEQ ID NO: 43646 - RNA, 18 nt, Homo sapiens
accaucacaaauaacaga

SEQ ID NO: 43647 - RNA, 20 nt, Homo sapiens
acuuaggcagcucugcuccu

SEQ ID NO: 43648 - RNA, 19 nt, Homo sapiens
cagcaaccaucacaaauaa

SEQ ID NO: 43649 - RNA, 22 nt, Homo sapiens
caggauuauaauaggccuguua

SEQ ID NO: 43650 - RNA, 20 nt, Homo sapiens
cauggauauuucugcuaugc

SEQ ID NO: 43651 - RNA, 17 nt, Homo sapiens
ccacuugaugcacaaau

SEQ ID NO: 43652 - RNA, 22 nt, Homo sapiens
gaagucuucuccuggaacucaa

SEQ ID NO: 43653 - RNA, 16 nt, Homo sapiens
gauaaacaagaugcug

SEQ ID NO: 43654 - RNA, 21 nt, Homo sapiens
gaugaaaaaagagcuuucaag

SEQ ID NO: 43655 - RNA, 19 nt, Homo sapiens
uagcauuaacaucugcaag

SEQ ID NO: 43656 - RNA, 18 nt, Homo sapiens
uccuaaaauuuuccaaca

SEQ ID NO: 43657 - RNA, 20 nt, Homo sapiens
uccuggaacucaagacuugc

SEQ ID NO: 43658 - RNA, 22 nt, Homo sapiens
gagaaguaacagggaagcuaca

SEQ ID NO: 43659 - RNA, 19 nt, Homo sapiens
uggcagggccuagcugcua

SEQ ID NO: 43660 - RNA, 20 nt, Homo sapiens
agcuacaaaaaucuguauua

SEQ ID NO: 43661 - RNA, 22 nt, Homo sapiens
cccuccuuccuucuuucccuac

SEQ ID NO: 43662 - RNA, 24 nt, Homo sapiens
gcaaagagagcuccccugguucca

SEQ ID NO: 43663 - RNA, 22 nt, Homo sapiens
ggacuuggacagagggcccaca

SEQ ID NO: 43664 - RNA, 19 nt, Homo sapiens
ucuaccuucccacucaccu

SEQ ID NO: 43665 - RNA, 21 nt, Homo sapiens
cagggggagcugggccugguc

SEQ ID NO: 43666 - RNA, 18 nt, Homo sapiens
caugcuccucuuccccag

SEQ ID NO: 43667 - RNA, 19 nt, Homo sapiens
ccugagcaguccuuggccu

SEQ ID NO: 43668 - RNA, 19 nt, Homo sapiens
cucccccaccguugucuca

SEQ ID NO: 43669 - RNA, 21 nt, Homo sapiens
gggcaauguuaauuuagugga

SEQ ID NO: 43670 - RNA, 20 nt, Homo sapiens
uugcagguggccaaguuccu

SEQ ID NO: 43671 - RNA, 17 nt, Homo sapiens
aaccccugauuuauaua

SEQ ID NO: 43672 - RNA, 21 nt, Homo sapiens
aggauguuuuaugaagucaca

SEQ ID NO: 43673 - RNA, 23 nt, Homo sapiens
gcuucaagauggccgcuuggcuc

SEQ ID NO: 43674 - RNA, 21 nt, Homo sapiens
ggaggaggaggccgaggcgcc

SEQ ID NO: 43675 - RNA, 17 nt, Homo sapiens
guagccaugucacugug

SEQ ID NO: 43676 - RNA, 19 nt, Homo sapiens
uguggauaucuaauucuaa

SEQ ID NO: 43677 - RNA, 21 nt, Homo sapiens
uguuaaggaaaaaaauuuuaa

SEQ ID NO: 43678 - RNA, 22 nt, Homo sapiens
uuuauauagauaucuucaugcc

SEQ ID NO: 43679 - RNA, 17 nt, Homo sapiens
agaugccuucuaagcua

SEQ ID NO: 43680 - RNA, 19 nt, Homo sapiens
ccuuuggaaaacuugugaa

SEQ ID NO: 43681 - RNA, 20 nt, Homo sapiens
auaaaaaucauguguuauua

SEQ ID NO: 43682 - RNA, 19 nt, Homo sapiens
gcauuugugaauuuaauag

SEQ ID NO: 43683 - RNA, 18 nt, Homo sapiens
uagcacaguugcuuagua

SEQ ID NO: 43684 - RNA, 22 nt, Homo sapiens
uccaaaauaaccuaacugcagc

SEQ ID NO: 43685 - RNA, 22 nt, Homo sapiens
uccuacguuagaaaccauucuu

SEQ ID NO: 43686 - RNA, 21 nt, Homo sapiens
ucuuuuaucuguuguagcuuu

SEQ ID NO: 43687 - RNA, 23 nt, Homo sapiens
acuagggaucccucaucuguccc

SEQ ID NO: 43688 - RNA, 22 nt, Homo sapiens
cugggggugccaggaccaguca

SEQ ID NO: 43689 - RNA, 21 nt, Homo sapiens
cuuguaauccgaaucucuuuu

SEQ ID NO: 43690 - RNA, 16 nt, Homo sapiens
gagcuucccugacuca

SEQ ID NO: 43691 - RNA, 23 nt, Homo sapiens
gggcagggccccaggcauugcca

SEQ ID NO: 43692 - RNA, 20 nt, Homo sapiens
ucugucucauccaucaucau

SEQ ID NO: 43693 - RNA, 22 nt, Homo sapiens
gauggcuuugguugguccguga

SEQ ID NO: 43694 - RNA, 21 nt, Homo sapiens
cugaaaugaauguauuucucc

SEQ ID NO: 43695 - RNA, 22 nt, Homo sapiens
ucugggugauccaaucauuuuu

SEQ ID NO: 43696 - RNA, 20 nt, Homo sapiens
uccucuucuccccucacuuu

SEQ ID NO: 43697 - RNA, 19 nt, Homo sapiens
ugaaguuacaaaccuguaa

SEQ ID NO: 43698 - RNA, 22 nt, Homo sapiens
auucugaugaugacuccuacuc

SEQ ID NO: 43699 - RNA, 19 nt, Homo sapiens
acugucuguuguuuaccua

SEQ ID NO: 43700 - RNA, 21 nt, Homo sapiens
cccugaaacugagucugugga

SEQ ID NO: 43701 - RNA, 19 nt, Homo sapiens
gccugacccgcaaugggca

SEQ ID NO: 43702 - RNA, 19 nt, Homo sapiens
ugggccggccugacccgca

SEQ ID NO: 43703 - RNA, 22 nt, Homo sapiens
aacuuacugauuauuuucuuca

SEQ ID NO: 43704 - RNA, 16 nt, Homo sapiens
auggguuaggcauuaa

SEQ ID NO: 43705 - RNA, 18 nt, Homo sapiens
ucagauauuauugcuuua

SEQ ID NO: 43706 - RNA, 19 nt, Homo sapiens
uguuucugcaugaauauca

SEQ ID NO: 43707 - RNA, 18 nt, Homo sapiens
aaaacucuccucugcugc

SEQ ID NO: 43708 - RNA, 22 nt, Homo sapiens
accugauugugucucuuggucc

SEQ ID NO: 43709 - RNA, 18 nt, Homo sapiens
ccuuuguccccaccgcag

SEQ ID NO: 43710 - RNA, 18 nt, Homo sapiens
cugugcugcccugcccac

SEQ ID NO: 43711 - RNA, 19 nt, Homo sapiens
gaguacuacaguccuccca

SEQ ID NO: 43712 - RNA, 18 nt, Homo sapiens
gcucccaggcauucccca

SEQ ID NO: 43713 - RNA, 20 nt, Homo sapiens
guucuacccaggugcuagga

SEQ ID NO: 43714 - RNA, 21 nt, Homo sapiens
uggugacaugucuuuucuugc

SEQ ID NO: 43715 - RNA, 21 nt, Homo sapiens
cucuaacccauccucugccuc

SEQ ID NO: 43716 - RNA, 17 nt, Homo sapiens
ucaagugauucucuugc

SEQ ID NO: 43717 - RNA, 20 nt, Homo sapiens
uggccaggcuggucuugaac

SEQ ID NO: 43718 - RNA, 20 nt, Homo sapiens
agaaggccacaggccacugc

SEQ ID NO: 43719 - RNA, 19 nt, Homo sapiens
augaccaauccuaugucau

SEQ ID NO: 43720 - RNA, 20 nt, Homo sapiens
cacugcaaacccugcugccu

SEQ ID NO: 43721 - RNA, 22 nt, Homo sapiens
gccccuccccaccccugccuuu

SEQ ID NO: 43722 - RNA, 18 nt, Homo sapiens
gcuggggugacacugcuc

SEQ ID NO: 43723 - RNA, 24 nt, Homo sapiens
uuuuuuuauuucuuguuuuagucu

SEQ ID NO: 43724 - RNA, 21 nt, Homo sapiens
cagagcucagcgagaagcugu

SEQ ID NO: 43725 - RNA, 21 nt, Homo sapiens
cccaaguaucagcauauuucu

SEQ ID NO: 43726 - RNA, 21 nt, Homo sapiens
cugaagacuucuaagauauua

SEQ ID NO: 43727 - RNA, 19 nt, Homo sapiens
cugaaucaggguuccuuga

SEQ ID NO: 43728 - RNA, 19 nt, Homo sapiens
guuaacaucccacaacaac

SEQ ID NO: 43729 - RNA, 16 nt, Homo sapiens
ucuggacaugacacau

SEQ ID NO: 43730 - RNA, 21 nt, Homo sapiens
gcuuuuccaacaaaucuuuga

SEQ ID NO: 43731 - RNA, 16 nt, Homo sapiens
guaaugaaagcacuua

SEQ ID NO: 43732 - RNA, 23 nt, Homo sapiens
ucauuauucuugcagcuaagcaa

SEQ ID NO: 43733 - RNA, 23 nt, Homo sapiens
uugaaagaacaaaguuuacuuca

SEQ ID NO: 43734 - RNA, 19 nt, Homo sapiens
ggccacuuuguagaaauca

SEQ ID NO: 43735 - RNA, 23 nt, Homo sapiens
ucaccaggcaaauaccuguucug

SEQ ID NO: 43736 - RNA, 24 nt, Homo sapiens
uuugggggcccauuacacacccca

SEQ ID NO: 43737 - RNA, 22 nt, Homo sapiens
ccuuauggcuuaaaauuccuua

SEQ ID NO: 43738 - RNA, 18 nt, Homo sapiens
ugguuguguuuucagaau

SEQ ID NO: 43739 - RNA, 23 nt, Homo sapiens
ggggacgcgaguggcggccgcgg

SEQ ID NO: 43740 - RNA, 26 nt, Homo sapiens
agggacagcugcugggacccaccucc

SEQ ID NO: 43741 - RNA, 22 nt, Homo sapiens
ccaccccccacgucuguccucc

SEQ ID NO: 43742 - RNA, 18 nt, Homo sapiens
ccgggacaguguuguaca

SEQ ID NO: 43743 - RNA, 23 nt, Homo sapiens
gacccaccucccccuccccggcc

SEQ ID NO: 43744 - RNA, 19 nt, Homo sapiens
gcaaaagacuugagccauc

SEQ ID NO: 43745 - RNA, 23 nt, Homo sapiens
gcguucagacccagacgaugcca

SEQ ID NO: 43746 - RNA, 24 nt, Homo sapiens
uccaaagaaacacuaagcucucug

SEQ ID NO: 43747 - RNA, 19 nt, Homo sapiens
ugaaaucacuuuaccugca

SEQ ID NO: 43748 - RNA, 22 nt, Homo sapiens
acagcagcaccuccuccaugca

SEQ ID NO: 43749 - RNA, 22 nt, Homo sapiens
agcauuugcuuuccucugagau

SEQ ID NO: 43750 - RNA, 19 nt, Homo sapiens
augcaggccuuaacuuucc

SEQ ID NO: 43751 - RNA, 24 nt, Homo sapiens
aagaaucuuuccaaaguugucuca

SEQ ID NO: 43752 - RNA, 18 nt, Homo sapiens
agcccaaggagcgcucca

SEQ ID NO: 43753 - RNA, 20 nt, Homo sapiens
ucaaaugcaucaauucucua

SEQ ID NO: 43754 - RNA, 21 nt, Homo sapiens
agccaagaccucacacacaca

SEQ ID NO: 43755 - RNA, 18 nt, Homo sapiens
agccgcaacgccacccgc

SEQ ID NO: 43756 - RNA, 20 nt, Homo sapiens
ggucccggcucuguggguga

SEQ ID NO: 43757 - RNA, 22 nt, Homo sapiens
guguccagcauugcuggacucu

SEQ ID NO: 43758 - RNA, 19 nt, Homo sapiens
aagagacucuccugccuca

SEQ ID NO: 43759 - RNA, 18 nt, Homo sapiens
acuagcuaugaaauacuc

SEQ ID NO: 43760 - RNA, 17 nt, Homo sapiens
agugaagauuuaccucg

SEQ ID NO: 43761 - RNA, 19 nt, Homo sapiens
auucaacaagcaccuagua

SEQ ID NO: 43762 - RNA, 20 nt, Homo sapiens
cagaaaagacaaacaguaga

SEQ ID NO: 43763 - RNA, 17 nt, Homo sapiens
ccaauuauaguuugaca

SEQ ID NO: 43764 - RNA, 21 nt, Homo sapiens
cucauggagucaucuugcaca

SEQ ID NO: 43765 - RNA, 18 nt, Homo sapiens
gcuuuaacaguggagcug

SEQ ID NO: 43766 - RNA, 22 nt, Homo sapiens
uaaacuuaaaaagaaaaccuca

SEQ ID NO: 43767 - RNA, 18 nt, Homo sapiens
uccgccuccuggguucaa

SEQ ID NO: 43768 - RNA, 18 nt, Homo sapiens
uugaugaucacugugaaa

SEQ ID NO: 43769 - RNA, 18 nt, Homo sapiens
gaaguucauuuugguuua

SEQ ID NO: 43770 - RNA, 18 nt, Homo sapiens
augcugauuuggugacca

SEQ ID NO: 43771 - RNA, 22 nt, Homo sapiens
uccaaccuucccaaacgccucc

SEQ ID NO: 43772 - RNA, 23 nt, Homo sapiens
ugggggacccaauguaggagcug

SEQ ID NO: 43773 - RNA, 22 nt, Homo sapiens
uauuucaaaaacaugcuuuucc

SEQ ID NO: 43774 - RNA, 17 nt, Homo sapiens
uggucuauauaaccaca

SEQ ID NO: 43775 - RNA, 20 nt, Homo sapiens
acccaaaauucaccacagca

SEQ ID NO: 43776 - RNA, 24 nt, Homo sapiens
cauugcugcuccuuauuuauugua

SEQ ID NO: 43777 - RNA, 19 nt, Homo sapiens
aauuguguugggugugggu

SEQ ID NO: 43778 - RNA, 19 nt, Homo sapiens
cagcuggauccauccauca

SEQ ID NO: 43779 - RNA, 19 nt, Homo sapiens
cauggggccagcacuguca

SEQ ID NO: 43780 - RNA, 20 nt, Homo sapiens
guuggguuguagcuaggcuu

SEQ ID NO: 43781 - RNA, 18 nt, Homo sapiens
uaaaacacaucuagacaa

SEQ ID NO: 43782 - RNA, 22 nt, Homo sapiens
uuuuuuguuuagcuacaugauu

SEQ ID NO: 43783 - RNA, 19 nt, Homo sapiens
caugcauaccugcacugca

SEQ ID NO: 43784 - RNA, 18 nt, Homo sapiens
cccugcccagaaugccca

SEQ ID NO: 43785 - RNA, 26 nt, Homo sapiens
ugaguggggcccacaucguggagcug

SEQ ID NO: 43786 - RNA, 24 nt, Homo sapiens
uugagccccugcuggugugcugca

SEQ ID NO: 43787 - RNA, 20 nt, Homo sapiens
uucugucuuucuguucucac

SEQ ID NO: 43788 - RNA, 24 nt, Homo sapiens
acacacaguuggauaaacauauca

SEQ ID NO: 43789 - RNA, 19 nt, Homo sapiens
cccuucuauuuagaguaga

SEQ ID NO: 43790 - RNA, 20 nt, Homo sapiens
cuagagagcuggcccagcca

SEQ ID NO: 43791 - RNA, 18 nt, Homo sapiens
ugugcccucacagcaccg

SEQ ID NO: 43792 - RNA, 20 nt, Homo sapiens
aauucacauaauaaacgaug

SEQ ID NO: 43793 - RNA, 20 nt, Homo sapiens
aagacaccugucaaauguca

SEQ ID NO: 43794 - RNA, 19 nt, Homo sapiens
aagaccuaucaugccaaga

SEQ ID NO: 43795 - RNA, 22 nt, Homo sapiens
acucgccucugcuccugugguc

SEQ ID NO: 43796 - RNA, 19 nt, Homo sapiens
cccaguggccucgucccag

SEQ ID NO: 43797 - RNA, 17 nt, Homo sapiens
cccccugggauggcuca

SEQ ID NO: 43798 - RNA, 18 nt, Homo sapiens
ccgggugggggauuuugg

SEQ ID NO: 43799 - RNA, 19 nt, Homo sapiens
gcagagggaaccagcuuca

SEQ ID NO: 43800 - RNA, 19 nt, Homo sapiens
acaggaagcaaaugccuca

SEQ ID NO: 43801 - RNA, 19 nt, Homo sapiens
aguuucaggcaaugaagug

SEQ ID NO: 43802 - RNA, 25 nt, Homo sapiens
ccuuauuaauacggggaucugugag

SEQ ID NO: 43803 - RNA, 17 nt, Homo sapiens
uucuggcaaacaguguu

SEQ ID NO: 43804 - RNA, 18 nt, Homo sapiens
ccaccgccgccgacagcg

SEQ ID NO: 43805 - RNA, 19 nt, Homo sapiens
cgccgccugcgccgcgaga

SEQ ID NO: 43806 - RNA, 23 nt, Homo sapiens
aaaacaaacaauuauaauguugu

SEQ ID NO: 43807 - RNA, 20 nt, Homo sapiens
acuggugcagcugcuggcca

SEQ ID NO: 43808 - RNA, 20 nt, Homo sapiens
aggcccugugcacguccuca

SEQ ID NO: 43809 - RNA, 21 nt, Homo sapiens
cacaucaccgccuuguuccuc

SEQ ID NO: 43810 - RNA, 20 nt, Homo sapiens
gaucccaccauuagccugua

SEQ ID NO: 43811 - RNA, 20 nt, Homo sapiens
gguguugaugccaauaacca

SEQ ID NO: 43812 - RNA, 20 nt, Homo sapiens
ucuacuaauguugugugauu

SEQ ID NO: 43813 - RNA, 20 nt, Homo sapiens
agagaaacggacagaggcga

SEQ ID NO: 43814 - RNA, 22 nt, Homo sapiens
agugaggguuucugugcuguca

SEQ ID NO: 43815 - RNA, 19 nt, Homo sapiens
caucccagcgggcaucuca

SEQ ID NO: 43816 - RNA, 22 nt, Homo sapiens
ccccuagcaccugccguccuca

SEQ ID NO: 43817 - RNA, 20 nt, Homo sapiens
cgugaauacuuccuguccua

SEQ ID NO: 43818 - RNA, 25 nt, Homo sapiens
gcuggcgaugauccacacugggaua

SEQ ID NO: 43819 - RNA, 19 nt, Homo sapiens
guagucuuaaaucauguga

SEQ ID NO: 43820 - RNA, 19 nt, Homo sapiens
aagcaauucuccugccuca

SEQ ID NO: 43821 - RNA, 21 nt, Homo sapiens
aucuugguucacugcaaccuc

SEQ ID NO: 43822 - RNA, 18 nt, Homo sapiens
ccugcaaccuccaccucc

SEQ ID NO: 43823 - RNA, 22 nt, Homo sapiens
gagccaagauugcgccgcuaca

SEQ ID NO: 43824 - RNA, 19 nt, Homo sapiens
ggauuucuaaaagauuucc

SEQ ID NO: 43825 - RNA, 18 nt, Homo sapiens
uccacuuccuagguucaa

SEQ ID NO: 43826 - RNA, 18 nt, Homo sapiens
ucucuacuaaaaauacaa

SEQ ID NO: 43827 - RNA, 18 nt, Homo sapiens
ccugagccuguauggccc

SEQ ID NO: 43828 - RNA, 22 nt, Homo sapiens
gcaggaaggaggauggcugugu

SEQ ID NO: 43829 - RNA, 17 nt, Homo sapiens
gcuuugauucuugguuc

SEQ ID NO: 43830 - RNA, 19 nt, Homo sapiens
gggcagagcugggccuguc

SEQ ID NO: 43831 - RNA, 18 nt, Homo sapiens
agacauucaggcaucaga

SEQ ID NO: 43832 - RNA, 21 nt, Homo sapiens
uaggugggcccaccacuugag

SEQ ID NO: 43833 - RNA, 22 nt, Homo sapiens
cuuuggggccgggaacuugcgg

SEQ ID NO: 43834 - RNA, 20 nt, Homo sapiens
gcaguaacauuggguccugg

SEQ ID NO: 43835 - RNA, 21 nt, Homo sapiens
gguuuugguguccugcuacaa

SEQ ID NO: 43836 - RNA, 20 nt, Homo sapiens
ucucccauggcuuaaugcuu

SEQ ID NO: 43837 - RNA, 26 nt, Homo sapiens
gaagaaaacacagagaaagccguuga

SEQ ID NO: 43838 - RNA, 15 nt, Homo sapiens
ccuuuaagaggcgga

SEQ ID NO: 43839 - RNA, 19 nt, Homo sapiens
caugccuucacaucacaac

SEQ ID NO: 43840 - RNA, 24 nt, Homo sapiens
cccgccgcccgccgcggcccggua

SEQ ID NO: 43841 - RNA, 23 nt, Homo sapiens
gcgccggcuucuucccagcgcga

SEQ ID NO: 43842 - RNA, 16 nt, Homo sapiens
ucaaaggccauuucca

SEQ ID NO: 43843 - RNA, 17 nt, Homo sapiens
caaaaccaagaugguga

SEQ ID NO: 43844 - RNA, 19 nt, Homo sapiens
cccugccagcacccgugca

SEQ ID NO: 43845 - RNA, 19 nt, Homo sapiens
cuccccuuacauacauaca

SEQ ID NO: 43846 - RNA, 22 nt, Homo sapiens
uggugucaucagcuguuucucc

SEQ ID NO: 43847 - RNA, 23 nt, Homo sapiens
accuaauuuuccugggacugcca

SEQ ID NO: 43848 - RNA, 22 nt, Homo sapiens
accucuuuuagaaaacuugaca

SEQ ID NO: 43849 - RNA, 20 nt, Homo sapiens
cauguccucucaccccauga

SEQ ID NO: 43850 - RNA, 20 nt, Homo sapiens
cuuuuuacguuugcagaugc

SEQ ID NO: 43851 - RNA, 20 nt, Homo sapiens
gcagaugccaaaauaauguc

SEQ ID NO: 43852 - RNA, 19 nt, Homo sapiens
gcaggucucucagcacuga

SEQ ID NO: 43853 - RNA, 20 nt, Homo sapiens
caggauacgauaccuugcca

SEQ ID NO: 43854 - RNA, 19 nt, Homo sapiens
acagaggcacagggcaggc

SEQ ID NO: 43855 - RNA, 24 nt, Homo sapiens
acagaaaccaucaucgucuuugua

SEQ ID NO: 43856 - RNA, 17 nt, Homo sapiens
agcaaaccauuucucuc

SEQ ID NO: 43857 - RNA, 17 nt, Homo sapiens
agcuuggaacuccauca

SEQ ID NO: 43858 - RNA, 21 nt, Homo sapiens
cagucacugucccagacggca

SEQ ID NO: 43859 - RNA, 17 nt, Homo sapiens
caucacaaucucaccca

SEQ ID NO: 43860 - RNA, 18 nt, Homo sapiens
cugcauccuaccccaccu

SEQ ID NO: 43861 - RNA, 22 nt, Homo sapiens
gaaaaaggacaagagucugugu

SEQ ID NO: 43862 - RNA, 18 nt, Homo sapiens
ggacacccacuucccucu

SEQ ID NO: 43863 - RNA, 22 nt, Homo sapiens
gguguacacccaaccaaaguga

SEQ ID NO: 43864 - RNA, 20 nt, Homo sapiens
uccugcuuggggacuggugg

SEQ ID NO: 43865 - RNA, 20 nt, Homo sapiens
ugcaaccaucucugggcuca

SEQ ID NO: 43866 - RNA, 20 nt, Homo sapiens
aucauucguuuguugagcaa

SEQ ID NO: 43867 - RNA, 19 nt, Homo sapiens
ccacggggccccuucccuc

SEQ ID NO: 43868 - RNA, 17 nt, Homo sapiens
cccucaguauccaccuu

SEQ ID NO: 43869 - RNA, 25 nt, Homo sapiens
ucaccaaccuggcucucccaccucc

SEQ ID NO: 43870 - RNA, 18 nt, Homo sapiens
aagauagcugggcccagu

SEQ ID NO: 43871 - RNA, 17 nt, Homo sapiens
agugaccuugccaguga

SEQ ID NO: 43872 - RNA, 18 nt, Homo sapiens
cauagauguuaaaauuuc

SEQ ID NO: 43873 - RNA, 18 nt, Homo sapiens
ccagcgugucuguuccag

SEQ ID NO: 43874 - RNA, 19 nt, Homo sapiens
cugcggaggggggccgcga

SEQ ID NO: 43875 - RNA, 20 nt, Homo sapiens
cuuuccuuccccucugccuc

SEQ ID NO: 43876 - RNA, 19 nt, Homo sapiens
guuaaaugacagcauaaca

SEQ ID NO: 43877 - RNA, 15 nt, Homo sapiens
ucucugucccuugcc

SEQ ID NO: 43878 - RNA, 22 nt, Homo sapiens
ugagcuguucagcagguagcca

SEQ ID NO: 43879 - RNA, 22 nt, Homo sapiens
ugggcggcgugccugugccaac

SEQ ID NO: 43880 - RNA, 21 nt, Homo sapiens
uuuuuuacuaugcuuuggucu

SEQ ID NO: 43881 - RNA, 23 nt, Homo sapiens
uacaaaauuuaaugcaguauuua

SEQ ID NO: 43882 - RNA, 23 nt, Homo sapiens
gaauuaaaugcuuuacaacauga

SEQ ID NO: 43883 - RNA, 18 nt, Homo sapiens
gauugcucucauuuucuu

SEQ ID NO: 43884 - RNA, 24 nt, Homo sapiens
gcacugcuaacuuaaugcauccca

SEQ ID NO: 43885 - RNA, 19 nt, Homo sapiens
uccuaaaacuauuaucuga

SEQ ID NO: 43886 - RNA, 19 nt, Homo sapiens
uugcucgacauguaacaug

SEQ ID NO: 43887 - RNA, 17 nt, Homo sapiens
aaaaacaaacaagcaaa

SEQ ID NO: 43888 - RNA, 20 nt, Homo sapiens
auauacuaggcauaauauca

SEQ ID NO: 43889 - RNA, 19 nt, Homo sapiens
gaaaacaggaaaccauuga

SEQ ID NO: 43890 - RNA, 18 nt, Homo sapiens
ugaugaucauggagaaac

SEQ ID NO: 43891 - RNA, 20 nt, Homo sapiens
aaaugcaguaagcauguguu

SEQ ID NO: 43892 - RNA, 20 nt, Homo sapiens
uuuguaaauauauaaauaua

SEQ ID NO: 43893 - RNA, 25 nt, Homo sapiens
augggccccgauuccagcauggggc

SEQ ID NO: 43894 - RNA, 25 nt, Homo sapiens
ucagcgugcauguggaauccaucca

SEQ ID NO: 43895 - RNA, 22 nt, Homo sapiens
aggauuacaaaggauuuagccu

SEQ ID NO: 43896 - RNA, 17 nt, Homo sapiens
aggcagaagaaucacuu

SEQ ID NO: 43897 - RNA, 25 nt, Homo sapiens
ccuacagcuaacauuauccuugaug

SEQ ID NO: 43898 - RNA, 18 nt, Homo sapiens
ggcaaaacuauugagcca

SEQ ID NO: 43899 - RNA, 20 nt, Homo sapiens
guucacugauguguuuuuga

SEQ ID NO: 43900 - RNA, 19 nt, Homo sapiens
uaagauuauacagucuagu

SEQ ID NO: 43901 - RNA, 20 nt, Homo sapiens
ugggugacagaaugagacug

SEQ ID NO: 43902 - RNA, 19 nt, Homo sapiens
ugugaagauuguacacuau

SEQ ID NO: 43903 - RNA, 21 nt, Homo sapiens
ugaucccaccacagcauucca

SEQ ID NO: 43904 - RNA, 18 nt, Homo sapiens
auauccccaaaugcuuau

SEQ ID NO: 43905 - RNA, 26 nt, Homo sapiens
cuuggguagccauagaaaucauuuuu

SEQ ID NO: 43906 - RNA, 21 nt, Homo sapiens
ugagauuuuagaggccuaguu

SEQ ID NO: 43907 - RNA, 18 nt, Homo sapiens
aaggugcacacugcugug

SEQ ID NO: 43908 - RNA, 17 nt, Homo sapiens
cacagggccccacgcag

SEQ ID NO: 43909 - RNA, 18 nt, Homo sapiens
cugggauccacuguuucc

SEQ ID NO: 43910 - RNA, 19 nt, Homo sapiens
gcauuaaaaacagcuaaau

SEQ ID NO: 43911 - RNA, 18 nt, Homo sapiens
gcggaguugggagccuuu

SEQ ID NO: 43912 - RNA, 22 nt, Homo sapiens
ggccugcuccacuugucuggga

SEQ ID NO: 43913 - RNA, 22 nt, Homo sapiens
gguggguggaggggacaguguu

SEQ ID NO: 43914 - RNA, 16 nt, Homo sapiens
ucucucucugucccgg

SEQ ID NO: 43915 - RNA, 21 nt, Homo sapiens
aaccccuggcaccuacugcuu

SEQ ID NO: 43916 - RNA, 21 nt, Homo sapiens
ccuuggcaggaggauuugggg

SEQ ID NO: 43917 - RNA, 19 nt, Homo sapiens
ggaaccugccugaagccac

SEQ ID NO: 43918 - RNA, 20 nt, Homo sapiens
acccaaagaggguucacuuu

SEQ ID NO: 43919 - RNA, 21 nt, Homo sapiens
aucuuaaauuguuguaucaua

SEQ ID NO: 43920 - RNA, 20 nt, Homo sapiens
caaagaggguucacuuuugc

SEQ ID NO: 43921 - RNA, 19 nt, Homo sapiens
cguaugauuuuauuucaua

SEQ ID NO: 43922 - RNA, 22 nt, Homo sapiens
uucacagaaacccucccucaug

SEQ ID NO: 43923 - RNA, 20 nt, Homo sapiens
uugaaaauuugaccuuuaaa

SEQ ID NO: 43924 - RNA, 17 nt, Homo sapiens
uuucccagaggucuuga

SEQ ID NO: 43925 - RNA, 21 nt, Homo sapiens
agaaaucuuaacucuuugaaa

SEQ ID NO: 43926 - RNA, 21 nt, Homo sapiens
gggaggagaaucugauuucca

SEQ ID NO: 43927 - RNA, 24 nt, Homo sapiens
guguuuuguuguuuugggaauuuu

SEQ ID NO: 43928 - RNA, 21 nt, Homo sapiens
accuccccgacugcugggccc

SEQ ID NO: 43929 - RNA, 18 nt, Homo sapiens
ccuucuggaacaauacag

SEQ ID NO: 43930 - RNA, 19 nt, Homo sapiens
ccaagaaugucuugucaua

SEQ ID NO: 43931 - RNA, 23 nt, Homo sapiens
uaguaucuguuacguccaaaaua

SEQ ID NO: 43932 - RNA, 21 nt, Homo sapiens
uccaugaauucauaauacuca

SEQ ID NO: 43933 - RNA, 20 nt, Homo sapiens
acguacgggccgcugcagcu

SEQ ID NO: 43934 - RNA, 24 nt, Homo sapiens
caucugcacuggcccccaagguca

SEQ ID NO: 43935 - RNA, 19 nt, Homo sapiens
cuaggccggggguuugagg

SEQ ID NO: 43936 - RNA, 16 nt, Homo sapiens
gccggggguuugagga

SEQ ID NO: 43937 - RNA, 21 nt, Homo sapiens
gccuggcugccucaggagcca

SEQ ID NO: 43938 - RNA, 21 nt, Homo sapiens
gcggcucugccggggacaaag

SEQ ID NO: 43939 - RNA, 20 nt, Homo sapiens
ggugucccgcccgccgccuc

SEQ ID NO: 43940 - RNA, 22 nt, Homo sapiens
agaaaccucacgccaugcugua

SEQ ID NO: 43941 - RNA, 19 nt, Homo sapiens
ccugagggugcggugguga

SEQ ID NO: 43942 - RNA, 19 nt, Homo sapiens
cugucuccugcuggcauuc

SEQ ID NO: 43943 - RNA, 18 nt, Homo sapiens
gacccugguugaguggca

SEQ ID NO: 43944 - RNA, 17 nt, Homo sapiens
ucaagugauucuccugc

SEQ ID NO: 43945 - RNA, 19 nt, Homo sapiens
uguuggauuauauaucaaa

SEQ ID NO: 43946 - RNA, 19 nt, Homo sapiens
agaauacaacagguagcca

SEQ ID NO: 43947 - RNA, 18 nt, Homo sapiens
guagagcugaugaucuca

SEQ ID NO: 43948 - RNA, 22 nt, Homo sapiens
aaacaccagauagaagaucuua

SEQ ID NO: 43949 - RNA, 18 nt, Homo sapiens
aaacagaaaccaaucggu

SEQ ID NO: 43950 - RNA, 18 nt, Homo sapiens
cagcaggggagcuuucgu

SEQ ID NO: 43951 - RNA, 21 nt, Homo sapiens
cgcgcgcagccguggcugcug

SEQ ID NO: 43952 - RNA, 18 nt, Homo sapiens
gggggcccccccgcuccc

SEQ ID NO: 43953 - RNA, 18 nt, Homo sapiens
guggccaacuucacuuug

SEQ ID NO: 43954 - RNA, 20 nt, Homo sapiens
ugaguuuucaguguuaaacu

SEQ ID NO: 43955 - RNA, 18 nt, Homo sapiens
acagaagacuucaagcca

SEQ ID NO: 43956 - RNA, 24 nt, Homo sapiens
ccuuaugcaguugcauuuaaccuu

SEQ ID NO: 43957 - RNA, 26 nt, Homo sapiens
cucauucuuuagucccugucaagguu

SEQ ID NO: 43958 - RNA, 19 nt, Homo sapiens
uauguuugacuugcuagua

SEQ ID NO: 43959 - RNA, 24 nt, Homo sapiens
ugagcucuucaagugauucugaua

SEQ ID NO: 43960 - RNA, 21 nt, Homo sapiens
uucaagugauucugauaacac

SEQ ID NO: 43961 - RNA, 20 nt, Homo sapiens
aaacaaacaacuaccacuuu

SEQ ID NO: 43962 - RNA, 17 nt, Homo sapiens
aacagcuaauacuacca

SEQ ID NO: 43963 - RNA, 22 nt, Homo sapiens
agaaaacaauaagccucugaaa

SEQ ID NO: 43964 - RNA, 17 nt, Homo sapiens
caucugucaguuauaga

SEQ ID NO: 43965 - RNA, 21 nt, Homo sapiens
cauuucccuuaucaaagaugu

SEQ ID NO: 43966 - RNA, 16 nt, Homo sapiens
ugcccucaacagcccc

SEQ ID NO: 43967 - RNA, 21 nt, Homo sapiens
ugugucaaaacuacuuagcaa

SEQ ID NO: 43968 - RNA, 24 nt, Homo sapiens
acagccucugaauuuauugcacca

SEQ ID NO: 43969 - RNA, 20 nt, Homo sapiens
uuuugcuaucucccauccca

SEQ ID NO: 43970 - RNA, 19 nt, Homo sapiens
uccuuguggacaguuguua

SEQ ID NO: 43971 - RNA, 22 nt, Homo sapiens
ugguuuaucacucuagauucaa

SEQ ID NO: 43972 - RNA, 21 nt, Homo sapiens
cagcuagaggagcacacucca

SEQ ID NO: 43973 - RNA, 19 nt, Homo sapiens
cuugaaacagugucugucu

SEQ ID NO: 43974 - RNA, 25 nt, Homo sapiens
gagaugaacucugaguaugaagcug

SEQ ID NO: 43975 - RNA, 19 nt, Homo sapiens
gugacaauguguccagcaa

SEQ ID NO: 43976 - RNA, 17 nt, Homo sapiens
guuccacuguauuguca

SEQ ID NO: 43977 - RNA, 19 nt, Homo sapiens
guugggcugcggugagucc

SEQ ID NO: 43978 - RNA, 24 nt, Homo sapiens
uaggcagcgcccuaauuggaauug

SEQ ID NO: 43979 - RNA, 21 nt, Homo sapiens
aaacuuuacuacuaucagaua

SEQ ID NO: 43980 - RNA, 18 nt, Homo sapiens
cuguauuggacuaauucu

SEQ ID NO: 43981 - RNA, 25 nt, Homo sapiens
uccugaggucgcgggaggcugcgag

SEQ ID NO: 43982 - RNA, 21 nt, Homo sapiens
ugcaguuuacugauggauuaa

SEQ ID NO: 43983 - RNA, 21 nt, Homo sapiens
aagagcuuuccaucuucauga

SEQ ID NO: 43984 - RNA, 15 nt, Homo sapiens
cucuccucucuccuc

SEQ ID NO: 43985 - RNA, 19 nt, Homo sapiens
cugagccugagguuugcuc

SEQ ID NO: 43986 - RNA, 20 nt, Homo sapiens
cuguuuugcccuuacucuca

SEQ ID NO: 43987 - RNA, 22 nt, Homo sapiens
ggaggagcccggugucucuaua

SEQ ID NO: 43988 - RNA, 17 nt, Homo sapiens
acuccaggaaaacuugc

SEQ ID NO: 43989 - RNA, 19 nt, Homo sapiens
aggaaauugguaauagcca

SEQ ID NO: 43990 - RNA, 20 nt, Homo sapiens
cagagcagugcaaaaguaga

SEQ ID NO: 43991 - RNA, 18 nt, Homo sapiens
cucucgggcauugcauuc

SEQ ID NO: 43992 - RNA, 18 nt, Homo sapiens
gggccagaacuucucucu

SEQ ID NO: 43993 - RNA, 18 nt, Homo sapiens
ucauaucuuucuuuuuca

SEQ ID NO: 43994 - RNA, 24 nt, Homo sapiens
uuuguauguuacuaacucacuuuu

SEQ ID NO: 43995 - RNA, 25 nt, Homo sapiens
acagucuucucugugcauuucccca

SEQ ID NO: 43996 - RNA, 17 nt, Homo sapiens
cucuuuauugaacauua

SEQ ID NO: 43997 - RNA, 23 nt, Homo sapiens
gggcaagacaauggaaacuucca

SEQ ID NO: 43998 - RNA, 21 nt, Homo sapiens
cccagacccgccaccgcaccc

SEQ ID NO: 43999 - RNA, 20 nt, Homo sapiens
gccaugcggugagcgcccca

SEQ ID NO: 44000 - RNA, 17 nt, Homo sapiens
ucccucagccgcuccca

SEQ ID NO: 44001 - RNA, 17 nt, Homo sapiens
ugccugacaacccuucu

SEQ ID NO: 44002 - RNA, 19 nt, Homo sapiens
uucucaccucccaaguccc

SEQ ID NO: 44003 - RNA, 20 nt, Homo sapiens
ccugcaccaccguuuuugaa

SEQ ID NO: 44004 - RNA, 21 nt, Homo sapiens
uccccuuucccuucccacucg

SEQ ID NO: 44005 - RNA, 18 nt, Homo sapiens
ggcccucccgcuuccccu

SEQ ID NO: 44006 - RNA, 17 nt, Homo sapiens
ggcgucggggccagcgg

SEQ ID NO: 44007 - RNA, 25 nt, Homo sapiens
accugcaaccauuugcauguguaca

SEQ ID NO: 44008 - RNA, 21 nt, Homo sapiens
aguaaacuuuugaagugucau

SEQ ID NO: 44009 - RNA, 21 nt, Homo sapiens
caucaagagagaaauaaauua

SEQ ID NO: 44010 - RNA, 19 nt, Homo sapiens
agcugucucagaauuccuc

SEQ ID NO: 44011 - RNA, 22 nt, Homo sapiens
ccaaaagagccacagaaucuca

SEQ ID NO: 44012 - RNA, 23 nt, Homo sapiens
ggacauucaaagugcccugugga

SEQ ID NO: 44013 - RNA, 20 nt, Homo sapiens
caucuuguugugucccaaga

SEQ ID NO: 44014 - RNA, 21 nt, Homo sapiens
cauuagauuggggguucuggg

SEQ ID NO: 44015 - RNA, 22 nt, Homo sapiens
gaaaggaccccugaccccuuuc

SEQ ID NO: 44016 - RNA, 20 nt, Homo sapiens
gcugcaauauaguguguguu

SEQ ID NO: 44017 - RNA, 24 nt, Homo sapiens
gcuucucugggcccuccucuccuc

SEQ ID NO: 44018 - RNA, 18 nt, Homo sapiens
guugguguccugcccucc

SEQ ID NO: 44019 - RNA, 23 nt, Homo sapiens
uaaagccagccccauagcugcuu

SEQ ID NO: 44020 - RNA, 20 nt, Homo sapiens
ugguccccggcauuagauug

SEQ ID NO: 44021 - RNA, 21 nt, Homo sapiens
aaccaaaacuuguucaucuca

SEQ ID NO: 44022 - RNA, 18 nt, Homo sapiens
acaacguuugggaaagua

SEQ ID NO: 44023 - RNA, 18 nt, Homo sapiens
acugcaacuuccaccucc

SEQ ID NO: 44024 - RNA, 23 nt, Homo sapiens
agaugggacgcaggacaccagcu

SEQ ID NO: 44025 - RNA, 21 nt, Homo sapiens
aucaauguaacuagaacagcu

SEQ ID NO: 44026 - RNA, 18 nt, Homo sapiens
cacguuuugccaaaaaug

SEQ ID NO: 44027 - RNA, 17 nt, Homo sapiens
cccaaaauaggacaaua

SEQ ID NO: 44028 - RNA, 19 nt, Homo sapiens
cugcaacuuccaccuccca

SEQ ID NO: 44029 - RNA, 23 nt, Homo sapiens
gaaacucauugaaaacaaugaca

SEQ ID NO: 44030 - RNA, 21 nt, Homo sapiens
gaauaauugcaguacuucucu

SEQ ID NO: 44031 - RNA, 22 nt, Homo sapiens
gagacccaagagccacaacuaa

SEQ ID NO: 44032 - RNA, 23 nt, Homo sapiens
gauuauaguuggugaauaaacua

SEQ ID NO: 44033 - RNA, 20 nt, Homo sapiens
ggguuacgccaccugcuuug

SEQ ID NO: 44034 - RNA, 22 nt, Homo sapiens
guguaagggugacauuugguua

SEQ ID NO: 44035 - RNA, 21 nt, Homo sapiens
uauguauuucucauuguuuua

SEQ ID NO: 44036 - RNA, 17 nt, Homo sapiens
ucaagcgauucuuaugc

SEQ ID NO: 44037 - RNA, 18 nt, Homo sapiens
uccaccucccagguucaa

SEQ ID NO: 44038 - RNA, 16 nt, Homo sapiens
uugucggcauguaaua

SEQ ID NO: 44039 - RNA, 18 nt, Homo sapiens
uuucauaucuuugccuaa

SEQ ID NO: 44040 - RNA, 19 nt, Homo sapiens
agucagcaucggaaucuca

SEQ ID NO: 44041 - RNA, 17 nt, Homo sapiens
augaacuagaagaucca

SEQ ID NO: 44042 - RNA, 23 nt, Homo sapiens
auguuuagaccggacacaacuca

SEQ ID NO: 44043 - RNA, 22 nt, Homo sapiens
cugcaaagcacugaucccuacc

SEQ ID NO: 44044 - RNA, 20 nt, Homo sapiens
cuuccaaauguaaccaugga

SEQ ID NO: 44045 - RNA, 19 nt, Homo sapiens
gaaaggauccauaugccaa

SEQ ID NO: 44046 - RNA, 18 nt, Homo sapiens
gucagcaucggaaucuca

SEQ ID NO: 44047 - RNA, 20 nt, Homo sapiens
cauugcuucaccuggcccca

SEQ ID NO: 44048 - RNA, 18 nt, Homo sapiens
cuuucacugguuuaugaa

SEQ ID NO: 44049 - RNA, 17 nt, Homo sapiens
gaccacucugcagcuca

SEQ ID NO: 44050 - RNA, 21 nt, Homo sapiens
ggcuguggacuuccucuacuu

SEQ ID NO: 44051 - RNA, 16 nt, Homo sapiens
caggccagacacccca

SEQ ID NO: 44052 - RNA, 18 nt, Homo sapiens
caguuuucagaauucuca

SEQ ID NO: 44053 - RNA, 18 nt, Homo sapiens
gaauucucacugaagcca

SEQ ID NO: 44054 - RNA, 18 nt, Homo sapiens
uaaguucaucuagaucuc

SEQ ID NO: 44055 - RNA, 21 nt, Homo sapiens
uaugcccaauaugcugccuca

SEQ ID NO: 44056 - RNA, 17 nt, Homo sapiens
uucuguccccuaaccuc

SEQ ID NO: 44057 - RNA, 20 nt, Homo sapiens
ccugggcugcccucacccca

SEQ ID NO: 44058 - RNA, 19 nt, Homo sapiens
aagauuguggggccgggcg

SEQ ID NO: 44059 - RNA, 16 nt, Homo sapiens
aguggagcuggagcug

SEQ ID NO: 44060 - RNA, 16 nt, Homo sapiens
cccugcacuugcucga

SEQ ID NO: 44061 - RNA, 17 nt, Homo sapiens
aacaauggcaacauggu

SEQ ID NO: 44062 - RNA, 19 nt, Homo sapiens
acccaacaccagaauccca

SEQ ID NO: 44063 - RNA, 17 nt, Homo sapiens
agaacacaaguuuuguc

SEQ ID NO: 44064 - RNA, 18 nt, Homo sapiens
caaaaagauacugguugc

SEQ ID NO: 44065 - RNA, 22 nt, Homo sapiens
ccuguucaucuccuccuuucuc

SEQ ID NO: 44066 - RNA, 21 nt, Homo sapiens
gcaccucuauagccuuacuca

SEQ ID NO: 44067 - RNA, 21 nt, Homo sapiens
gccugagcccucucagaagca

SEQ ID NO: 44068 - RNA, 21 nt, Homo sapiens
ggauagagaaagugucuccca

SEQ ID NO: 44069 - RNA, 19 nt, Homo sapiens
gugagaacgagcacugcac

SEQ ID NO: 44070 - RNA, 21 nt, Homo sapiens
ugcagucuuguauuuguggug

SEQ ID NO: 44071 - RNA, 19 nt, Homo sapiens
uggcaggaucauucuugga

SEQ ID NO: 44072 - RNA, 18 nt, Homo sapiens
uugcggcugcugcuggcc

SEQ ID NO: 44073 - RNA, 20 nt, Homo sapiens
acgaacucucucuuacuccg

SEQ ID NO: 44074 - RNA, 21 nt, Homo sapiens
caugagccauaauuauuaaca

SEQ ID NO: 44075 - RNA, 20 nt, Homo sapiens
cuguccugucugugcuccca

SEQ ID NO: 44076 - RNA, 21 nt, Homo sapiens
cuucucaucugccuugguccu

SEQ ID NO: 44077 - RNA, 17 nt, Homo sapiens
ugaagaaauauuaaaca

SEQ ID NO: 44078 - RNA, 23 nt, Homo sapiens
uuagcuuccuaucagugggcuuu

SEQ ID NO: 44079 - RNA, 17 nt, Homo sapiens
agauucuguauuauccu

SEQ ID NO: 44080 - RNA, 20 nt, Homo sapiens
guaucagugcuacucggcua

SEQ ID NO: 44081 - RNA, 18 nt, Homo sapiens
guggcugggccucaguua

SEQ ID NO: 44082 - RNA, 24 nt, Homo sapiens
uguacuguguagcauaauaccaaa

SEQ ID NO: 44083 - RNA, 17 nt, Homo sapiens
gcggcgcgaccgccuca

SEQ ID NO: 44084 - RNA, 19 nt, Homo sapiens
caccaccaccaccaccauc

SEQ ID NO: 44085 - RNA, 23 nt, Homo sapiens
ccacuucaucauccccaccacca

SEQ ID NO: 44086 - RNA, 19 nt, Homo sapiens
cuugaaccggggucuggag

SEQ ID NO: 44087 - RNA, 22 nt, Homo sapiens
agagaagagaggagucaaccca

SEQ ID NO: 44088 - RNA, 19 nt, Homo sapiens
caaggaagagaaucuguca

SEQ ID NO: 44089 - RNA, 23 nt, Homo sapiens
cauguacugcaggugugcaguga

SEQ ID NO: 44090 - RNA, 18 nt, Homo sapiens
ccuaaaccaucuaccuca

SEQ ID NO: 44091 - RNA, 19 nt, Homo sapiens
ggaggggccacagaagaca

SEQ ID NO: 44092 - RNA, 20 nt, Homo sapiens
ggaggaggaagcugaagacg

SEQ ID NO: 44093 - RNA, 20 nt, Homo sapiens
ccaggaggacgcagaggcua

SEQ ID NO: 44094 - RNA, 24 nt, Homo sapiens
gaagaaaacccaggaggacgcaga

SEQ ID NO: 44095 - RNA, 18 nt, Homo sapiens
gguauucaaacagcucuu

SEQ ID NO: 44096 - RNA, 20 nt, Homo sapiens
ucugaagaugcauguuucca

SEQ ID NO: 44097 - RNA, 24 nt, Homo sapiens
acuuaccugaggaaagacagcaca

SEQ ID NO: 44098 - RNA, 23 nt, Homo sapiens
cuccaaagauauuugcacugcuu

SEQ ID NO: 44099 - RNA, 18 nt, Homo sapiens
cucuugaaaagagagcuc

SEQ ID NO: 44100 - RNA, 23 nt, Homo sapiens
cuugucuuucagaauaauuuuua

SEQ ID NO: 44101 - RNA, 20 nt, Homo sapiens
cuuuuggacaucaguuugug

SEQ ID NO: 44102 - RNA, 22 nt, Homo sapiens
ugauguaggauuaaacauucca

SEQ ID NO: 44103 - RNA, 18 nt, Homo sapiens
cugaacccauuuuccucc

SEQ ID NO: 44104 - RNA, 20 nt, Homo sapiens
uuuaaguaaucaccacuuuc

SEQ ID NO: 44105 - RNA, 21 nt, Homo sapiens
ggaagagaaagaucaacucac

SEQ ID NO: 44106 - RNA, 19 nt, Homo sapiens
ugcuuugguggagaauuuu

SEQ ID NO: 44107 - RNA, 19 nt, Homo sapiens
uggcucuuuaucuaccuuu

SEQ ID NO: 44108 - RNA, 17 nt, Homo sapiens
cgagagccgcuguugac

SEQ ID NO: 44109 - RNA, 22 nt, Homo sapiens
cuuuuuguguguguuuugcuuu

SEQ ID NO: 44110 - RNA, 18 nt, Homo sapiens
uguaauucauggucugga

SEQ ID NO: 44111 - RNA, 16 nt, Homo sapiens
uuuucacagcuuugua

SEQ ID NO: 44112 - RNA, 19 nt, Homo sapiens
agaaagaguggaagcacuu

SEQ ID NO: 44113 - RNA, 18 nt, Homo sapiens
acuuacucaucguuucaa

SEQ ID NO: 44114 - RNA, 19 nt, Homo sapiens
cgccagggucgcccaccca

SEQ ID NO: 44115 - RNA, 22 nt, Homo sapiens
ggacaaugcugauggaagacca

SEQ ID NO: 44116 - RNA, 19 nt, Homo sapiens
ggcaauuauggucacugga

SEQ ID NO: 44117 - RNA, 20 nt, Homo sapiens
ccaccaucagcaccaccucc

SEQ ID NO: 44118 - RNA, 21 nt, Homo sapiens
ccaccgccgccgccgccgcca

SEQ ID NO: 44119 - RNA, 20 nt, Homo sapiens
ccaccgccggcggcggcagc

SEQ ID NO: 44120 - RNA, 19 nt, Homo sapiens
ccucgcggcucgguccggc

SEQ ID NO: 44121 - RNA, 18 nt, Homo sapiens
gccucgccaccaucagca

SEQ ID NO: 44122 - RNA, 21 nt, Homo sapiens
aaauggucucauacacguaca

SEQ ID NO: 44123 - RNA, 19 nt, Homo sapiens
caguagcaguuacuuggca

SEQ ID NO: 44124 - RNA, 20 nt, Homo sapiens
cggggcagcggcuccugcag

SEQ ID NO: 44125 - RNA, 19 nt, Homo sapiens
ggccgggugcgguggcuca

SEQ ID NO: 44126 - RNA, 19 nt, Homo sapiens
gggcauuguuaaaguucca

SEQ ID NO: 44127 - RNA, 18 nt, Homo sapiens
uuauaugccugccacagu

SEQ ID NO: 44128 - RNA, 20 nt, Homo sapiens
uuuccacacaccaacaugug

SEQ ID NO: 44129 - RNA, 18 nt, Homo sapiens
uauucaccauuuucccug

SEQ ID NO: 44130 - RNA, 19 nt, Homo sapiens
ccagaucccuuccugccca

SEQ ID NO: 44131 - RNA, 23 nt, Homo sapiens
gguagcgagccagcuggauuccg

SEQ ID NO: 44132 - RNA, 20 nt, Homo sapiens
ugugccucucacuccgugga

SEQ ID NO: 44133 - RNA, 18 nt, Homo sapiens
ugcaaaacacuaggcuuu

SEQ ID NO: 44134 - RNA, 22 nt, Homo sapiens
gcuguaauguuuugccauguug

SEQ ID NO: 44135 - RNA, 17 nt, Homo sapiens
ggagaugaugucugcuu

SEQ ID NO: 44136 - RNA, 21 nt, Homo sapiens
uauuaauucagccaguguauc

SEQ ID NO: 44137 - RNA, 20 nt, Homo sapiens
aaaucaaauuaccuuuggaa

SEQ ID NO: 44138 - RNA, 18 nt, Homo sapiens
caaaguuacccuggaaca

SEQ ID NO: 44139 - RNA, 23 nt, Homo sapiens
ccuuuguaaguugguuugaucuu

SEQ ID NO: 44140 - RNA, 20 nt, Homo sapiens
agugauuuucuuaauaccuu

SEQ ID NO: 44141 - RNA, 23 nt, Homo sapiens
caaaauuuaauguguuccaugaa

SEQ ID NO: 44142 - RNA, 18 nt, Homo sapiens
cccagccccucacagcuu

SEQ ID NO: 44143 - RNA, 21 nt, Homo sapiens
cucccgaguggaggucgugag

SEQ ID NO: 44144 - RNA, 19 nt, Homo sapiens
gaaacucccaucuaccccu

SEQ ID NO: 44145 - RNA, 18 nt, Homo sapiens
ggaaaauuuauugaauca

SEQ ID NO: 44146 - RNA, 18 nt, Homo sapiens
ccuauauauagacaguag

SEQ ID NO: 44147 - RNA, 23 nt, Homo sapiens
cuucaccagaccacuggcacaca

SEQ ID NO: 44148 - RNA, 21 nt, Homo sapiens
ucaaagagauaucugcacucc

SEQ ID NO: 44149 - RNA, 17 nt, Homo sapiens
uuccuuuucucaugaaa

SEQ ID NO: 44150 - RNA, 22 nt, Homo sapiens
uuugugaccagaacacauuuaa

SEQ ID NO: 44151 - RNA, 21 nt, Homo sapiens
acccaucccagaacuacucca

SEQ ID NO: 44152 - RNA, 23 nt, Homo sapiens
auccuauugaccgaagcugucaa

SEQ ID NO: 44153 - RNA, 18 nt, Homo sapiens
aauccucaaaaauaguca

SEQ ID NO: 44154 - RNA, 21 nt, Homo sapiens
aucuuggcucacuccaaccuc

SEQ ID NO: 44155 - RNA, 22 nt, Homo sapiens
augauccugaagaaaaagguga

SEQ ID NO: 44156 - RNA, 16 nt, Homo sapiens
augucagucuaccuua

SEQ ID NO: 44157 - RNA, 16 nt, Homo sapiens
caaccaaaaacugccu

SEQ ID NO: 44158 - RNA, 17 nt, Homo sapiens
cacaguaccacccaucu

SEQ ID NO: 44159 - RNA, 22 nt, Homo sapiens
cucagcagagcucacaguacca

SEQ ID NO: 44160 - RNA, 20 nt, Homo sapiens
gauccugaagaaaaagguga

SEQ ID NO: 44161 - RNA, 19 nt, Homo sapiens
gggacugagcggcggcggc

SEQ ID NO: 44162 - RNA, 21 nt, Homo sapiens
guauuacacaaaaucuggacu

SEQ ID NO: 44163 - RNA, 17 nt, Homo sapiens
ucaagugauucuccugc

SEQ ID NO: 44164 - RNA, 18 nt, Homo sapiens
uccaccuuccagguucaa

SEQ ID NO: 44165 - RNA, 18 nt, Homo sapiens
ugaagaaaaaggugacaa

SEQ ID NO: 44166 - RNA, 18 nt, Homo sapiens
ugcaccuuuuaaagcacu

SEQ ID NO: 44167 - RNA, 18 nt, Homo sapiens
ccugcaaccuccaccucc

SEQ ID NO: 44168 - RNA, 18 nt, Homo sapiens
cugcacccuguuuccuuu

SEQ ID NO: 44169 - RNA, 22 nt, Homo sapiens
gacgggguuucaccaugcuggc

SEQ ID NO: 44170 - RNA, 16 nt, Homo sapiens
uacuuguaagccaagc

SEQ ID NO: 44171 - RNA, 18 nt, Homo sapiens
uccaccucccggguucaa

SEQ ID NO: 44172 - RNA, 24 nt, Homo sapiens
ugcccuugggaauacuccugcaca

SEQ ID NO: 44173 - RNA, 18 nt, Homo sapiens
aagaaaucuggaaaucua

SEQ ID NO: 44174 - RNA, 20 nt, Homo sapiens
gagauggaagaacuugcaaa

SEQ ID NO: 44175 - RNA, 22 nt, Homo sapiens
gccaagguccugcucaacucua

SEQ ID NO: 44176 - RNA, 20 nt, Homo sapiens
uugcucccaacccauucacu

SEQ ID NO: 44177 - RNA, 20 nt, Homo sapiens
ucuuggcggcgggagaggcg

SEQ ID NO: 44178 - RNA, 19 nt, Homo sapiens
agcuguucacugccagcuc

SEQ ID NO: 44179 - RNA, 18 nt, Homo sapiens
caggccucccccgccuca

SEQ ID NO: 44180 - RNA, 20 nt, Homo sapiens
ccugcgcauguaccccugaa

SEQ ID NO: 44181 - RNA, 26 nt, Homo sapiens
gaaagaacaagaucaugcccuuugca

SEQ ID NO: 44182 - RNA, 22 nt, Homo sapiens
aaauaauuguuauguuucuguu

SEQ ID NO: 44183 - RNA, 18 nt, Homo sapiens
gaaauaugauccuccuga

SEQ ID NO: 44184 - RNA, 24 nt, Homo sapiens
gcucaaaaauggaaacugaaagca

SEQ ID NO: 44185 - RNA, 17 nt, Homo sapiens
uaugucauuagauccaa

SEQ ID NO: 44186 - RNA, 19 nt, Homo sapiens
cacguggcccugagccaca

SEQ ID NO: 44187 - RNA, 22 nt, Homo sapiens
cgcgcgccuccuuccucgccgc

SEQ ID NO: 44188 - RNA, 21 nt, Homo sapiens
augucuagcggcgaacacuuc

SEQ ID NO: 44189 - RNA, 16 nt, Homo sapiens
cccaggagccccccag

SEQ ID NO: 44190 - RNA, 22 nt, Homo sapiens
ggacuaauccaucgaugacugg

SEQ ID NO: 44191 - RNA, 19 nt, Homo sapiens
ucgaugacuggaaaagagg

SEQ ID NO: 44192 - RNA, 19 nt, Homo sapiens
uuucuuuagaucugugcag

SEQ ID NO: 44193 - RNA, 21 nt, Homo sapiens
uugaagacaccccacauucca

SEQ ID NO: 44194 - RNA, 21 nt, Homo sapiens
aagcuccagaagguucuauua

SEQ ID NO: 44195 - RNA, 18 nt, Homo sapiens
ggccggguguggugguuc

SEQ ID NO: 44196 - RNA, 18 nt, Homo sapiens
uugcuauuacuucuuuca

SEQ ID NO: 44197 - RNA, 21 nt, Homo sapiens
acccugaucaaaggaggguga

SEQ ID NO: 44198 - RNA, 24 nt, Homo sapiens
accugccggggacugccguggcuu

SEQ ID NO: 44199 - RNA, 21 nt, Homo sapiens
accuucuggcagcucugggga

SEQ ID NO: 44200 - RNA, 17 nt, Homo sapiens
caacccuccaguccccu

SEQ ID NO: 44201 - RNA, 18 nt, Homo sapiens
gccacauguggcaagugg

SEQ ID NO: 44202 - RNA, 20 nt, Homo sapiens
gggagucuccccaggacggc

SEQ ID NO: 44203 - RNA, 17 nt, Homo sapiens
guuacucaccugucauu

SEQ ID NO: 44204 - RNA, 20 nt, Homo sapiens
uggagagagguggcagguga

SEQ ID NO: 44205 - RNA, 22 nt, Homo sapiens
ugggagccugcccuggacucca

SEQ ID NO: 44206 - RNA, 25 nt, Homo sapiens
uguagggcagguagggugugugcug

SEQ ID NO: 44207 - RNA, 21 nt, Homo sapiens
aguaacugcccuguguuguca

SEQ ID NO: 44208 - RNA, 23 nt, Homo sapiens
ccacauuucucucuucucccuca

SEQ ID NO: 44209 - RNA, 22 nt, Homo sapiens
ccuccuuuccccucuucccugg

SEQ ID NO: 44210 - RNA, 25 nt, Homo sapiens
gccucuuucccuccuccucucccuc

SEQ ID NO: 44211 - RNA, 19 nt, Homo sapiens
cuccccauccccaucuggu

SEQ ID NO: 44212 - RNA, 24 nt, Homo sapiens
aauaaguaucuuugggaaaucuuu

SEQ ID NO: 44213 - RNA, 18 nt, Homo sapiens
aauaguggaaaugaugaa

SEQ ID NO: 44214 - RNA, 18 nt, Homo sapiens
accguacguugccaaaua

SEQ ID NO: 44215 - RNA, 18 nt, Homo sapiens
aguaaccacaaauugcca

SEQ ID NO: 44216 - RNA, 20 nt, Homo sapiens
augugaauacagauaucaca

SEQ ID NO: 44217 - RNA, 17 nt, Homo sapiens
guuuuuauucucacuua

SEQ ID NO: 44218 - RNA, 22 nt, Homo sapiens
ugaaagaagagacaggcaauga

SEQ ID NO: 44219 - RNA, 18 nt, Homo sapiens
aagguuauccaguucagu

SEQ ID NO: 44220 - RNA, 20 nt, Homo sapiens
aaucuuccccagauucaucu

SEQ ID NO: 44221 - RNA, 19 nt, Homo sapiens
agggaaugaaucgauuugc

SEQ ID NO: 44222 - RNA, 18 nt, Homo sapiens
augagaaagcugggcaaa

SEQ ID NO: 44223 - RNA, 22 nt, Homo sapiens
gcccaaugaccggguuuucgca

SEQ ID NO: 44224 - RNA, 24 nt, Homo sapiens
ggcaugagccaccgcacccggcca

SEQ ID NO: 44225 - RNA, 23 nt, Homo sapiens
ucaauacgaucaugauucaagau

SEQ ID NO: 44226 - RNA, 18 nt, Homo sapiens
ucaugauucaagauccaa

SEQ ID NO: 44227 - RNA, 23 nt, Homo sapiens
uccucaaauaccucaaauaccuc

SEQ ID NO: 44228 - RNA, 24 nt, Homo sapiens
aaaucuccaucugacccuacauaa

SEQ ID NO: 44229 - RNA, 22 nt, Homo sapiens
agaaauugcaagauguaauaua

SEQ ID NO: 44230 - RNA, 19 nt, Homo sapiens
cuuuaccugucaucaguua

SEQ ID NO: 44231 - RNA, 19 nt, Homo sapiens
gagcuccugcauaguaugc

SEQ ID NO: 44232 - RNA, 23 nt, Homo sapiens
uucaagauaaacuucuguaaccu

SEQ ID NO: 44233 - RNA, 17 nt, Homo sapiens
uucagcuacaauacuca

SEQ ID NO: 44234 - RNA, 19 nt, Homo sapiens
acagaaauauuuucaaacc

SEQ ID NO: 44235 - RNA, 19 nt, Homo sapiens
augaggcuguaguguaaga

SEQ ID NO: 44236 - RNA, 19 nt, Homo sapiens
ggaucccaggcuacuagug

SEQ ID NO: 44237 - RNA, 18 nt, Homo sapiens
uuuguauaaaacaauagg

SEQ ID NO: 44238 - RNA, 17 nt, Homo sapiens
agaagaaaagagcaccu

SEQ ID NO: 44239 - RNA, 17 nt, Homo sapiens
ccucacaggcuguugug

SEQ ID NO: 44240 - RNA, 20 nt, Homo sapiens
guuggacuuagugccugucu

SEQ ID NO: 44241 - RNA, 17 nt, Homo sapiens
ucuggcgagggcugcgg

SEQ ID NO: 44242 - RNA, 22 nt, Homo sapiens
uuccuguccucugcucugugga

SEQ ID NO: 44243 - RNA, 24 nt, Homo sapiens
aucugaauagcaacugucugacuu

SEQ ID NO: 44244 - RNA, 21 nt, Homo sapiens
augacugaguaagaguuuuga

SEQ ID NO: 44245 - RNA, 17 nt, Homo sapiens
gcccgagacccauacca

SEQ ID NO: 44246 - RNA, 23 nt, Homo sapiens
ggcguccacuccaaaacauauca

SEQ ID NO: 44247 - RNA, 22 nt, Homo sapiens
ggggauggcaacagcauuggug

SEQ ID NO: 44248 - RNA, 18 nt, Homo sapiens
aacugccagcucagaaua

SEQ ID NO: 44249 - RNA, 21 nt, Homo sapiens
acuugaauggccuguuugucu

SEQ ID NO: 44250 - RNA, 17 nt, Homo sapiens
acuuuggccucugguuc

SEQ ID NO: 44251 - RNA, 19 nt, Homo sapiens
auguccauaagaaacccuu

SEQ ID NO: 44252 - RNA, 18 nt, Homo sapiens
cacuggucaugccauugc

SEQ ID NO: 44253 - RNA, 16 nt, Homo sapiens
ccuccaccaccacaau

SEQ ID NO: 44254 - RNA, 22 nt, Homo sapiens
gagccaagauugugccacuuca

SEQ ID NO: 44255 - RNA, 19 nt, Homo sapiens
gcaguggggaccauugagc

SEQ ID NO: 44256 - RNA, 15 nt, Homo sapiens
ggcagagcuuauccu

SEQ ID NO: 44257 - RNA, 21 nt, Homo sapiens
ggcugauuaaagaaguucuug

SEQ ID NO: 44258 - RNA, 19 nt, Homo sapiens
uaauauaaagcuguguguu

SEQ ID NO: 44259 - RNA, 19 nt, Homo sapiens
ucauguuguuaagcaguua

SEQ ID NO: 44260 - RNA, 24 nt, Homo sapiens
ucucugugggucucaugaacagca

SEQ ID NO: 44261 - RNA, 19 nt, Homo sapiens
ucuuucucugugggucuca

SEQ ID NO: 44262 - RNA, 21 nt, Homo sapiens
aguggguggagaccugcuguc

SEQ ID NO: 44263 - RNA, 21 nt, Homo sapiens
ccacagugcuggcuucuuccc

SEQ ID NO: 44264 - RNA, 18 nt, Homo sapiens
cccugaggguagccaugc

SEQ ID NO: 44265 - RNA, 20 nt, Homo sapiens
agugacccuucuccaccccc

SEQ ID NO: 44266 - RNA, 24 nt, Homo sapiens
augccucauuugccucucgcuucu

SEQ ID NO: 44267 - RNA, 23 nt, Homo sapiens
cccuucuccacccccauauccua

SEQ ID NO: 44268 - RNA, 23 nt, Homo sapiens
cgaaagguggagagaucugugag

SEQ ID NO: 44269 - RNA, 18 nt, Homo sapiens
uccagggccacguuccag

SEQ ID NO: 44270 - RNA, 23 nt, Homo sapiens
ugcaggaggccccugugcaggug

SEQ ID NO: 44271 - RNA, 16 nt, Homo sapiens
aagggcuggguuuuga

SEQ ID NO: 44272 - RNA, 18 nt, Homo sapiens
aauugaaucuggagaguc

SEQ ID NO: 44273 - RNA, 21 nt, Homo sapiens
agaaaucuuaacucuuugaaa

SEQ ID NO: 44274 - RNA, 22 nt, Homo sapiens
cugcuuuguugcauguauccua

SEQ ID NO: 44275 - RNA, 20 nt, Homo sapiens
ugguccuccagcgugagcua

SEQ ID NO: 44276 - RNA, 24 nt, Homo sapiens
ccucccccucccaaucuccuucca

SEQ ID NO: 44277 - RNA, 22 nt, Homo sapiens
ccuuuucuccacucccagcccc

SEQ ID NO: 44278 - RNA, 19 nt, Homo sapiens
cuccaaacuuucaacuuca

SEQ ID NO: 44279 - RNA, 20 nt, Homo sapiens
gauuuuucgguguuucucug

SEQ ID NO: 44280 - RNA, 20 nt, Homo sapiens
gcuuccuggcccccuccccc

SEQ ID NO: 44281 - RNA, 18 nt, Homo sapiens
cccccuccguuuuuucca

SEQ ID NO: 44282 - RNA, 24 nt, Homo sapiens
agaccccuccucagacccucccca

SEQ ID NO: 44283 - RNA, 21 nt, Homo sapiens
caggccuccacccccaccccc

SEQ ID NO: 44284 - RNA, 21 nt, Homo sapiens
ccaggccuccacccccacccc

SEQ ID NO: 44285 - RNA, 24 nt, Homo sapiens
ccugcccucccagucucccacccc

SEQ ID NO: 44286 - RNA, 20 nt, Homo sapiens
gcagguggagccaagcucuc

SEQ ID NO: 44287 - RNA, 19 nt, Homo sapiens
gucucccaccccggcccca

SEQ ID NO: 44288 - RNA, 19 nt, Homo sapiens
uuacagugucuguuggugg

SEQ ID NO: 44289 - RNA, 17 nt, Homo sapiens
gaccgcccacacauucc

SEQ ID NO: 44290 - RNA, 21 nt, Homo sapiens
aagaaugugcagugaaccuca

SEQ ID NO: 44291 - RNA, 20 nt, Homo sapiens
acagauagugugggcuucac

SEQ ID NO: 44292 - RNA, 21 nt, Homo sapiens
agccauguuuuucuucuguga

SEQ ID NO: 44293 - RNA, 18 nt, Homo sapiens
caguuuaauaauaucuca

SEQ ID NO: 44294 - RNA, 21 nt, Homo sapiens
gcuucuagguauuuuguauug

SEQ ID NO: 44295 - RNA, 20 nt, Homo sapiens
aacagggcacagagaugcca

SEQ ID NO: 44296 - RNA, 18 nt, Homo sapiens
cauuuaacucugcuagau

SEQ ID NO: 44297 - RNA, 19 nt, Homo sapiens
cucugacgguggcagcugu

SEQ ID NO: 44298 - RNA, 23 nt, Homo sapiens
gccccuguucuguccagcagcca

SEQ ID NO: 44299 - RNA, 21 nt, Homo sapiens
gcccgccuucacggcucugaa

SEQ ID NO: 44300 - RNA, 22 nt, Homo sapiens
ugcaaauuaaagaacuacuuga

SEQ ID NO: 44301 - RNA, 19 nt, Homo sapiens
acuauagggagagcaugga

SEQ ID NO: 44302 - RNA, 22 nt, Homo sapiens
auggaggagaaggaacuucuca

SEQ ID NO: 44303 - RNA, 23 nt, Homo sapiens
caagauacagcuaaauacauuua

SEQ ID NO: 44304 - RNA, 19 nt, Homo sapiens
ccuggaagauuucugguuu

SEQ ID NO: 44305 - RNA, 17 nt, Homo sapiens
ccuggcauaagauugca

SEQ ID NO: 44306 - RNA, 20 nt, Homo sapiens
ccuugagacacacucuuucc

SEQ ID NO: 44307 - RNA, 20 nt, Homo sapiens
cucuccucagucuuaucuga

SEQ ID NO: 44308 - RNA, 18 nt, Homo sapiens
uccuuucguauucaugga

SEQ ID NO: 44309 - RNA, 18 nt, Homo sapiens
uuacaaguuggcaaaaua

SEQ ID NO: 44310 - RNA, 19 nt, Homo sapiens
acccuuccaccccgccuca

SEQ ID NO: 44311 - RNA, 22 nt, Homo sapiens
accgcagaugcccuccucccuc

SEQ ID NO: 44312 - RNA, 19 nt, Homo sapiens
agcccccuccucccccggg

SEQ ID NO: 44313 - RNA, 23 nt, Homo sapiens
aguuuuccacucugccccgggga

SEQ ID NO: 44314 - RNA, 16 nt, Homo sapiens
cacaacaucugcucuu

SEQ ID NO: 44315 - RNA, 19 nt, Homo sapiens
ccugcaaggcucuuggccu

SEQ ID NO: 44316 - RNA, 19 nt, Homo sapiens
cuccagggcagggacucga

SEQ ID NO: 44317 - RNA, 17 nt, Homo sapiens
gacuccauuaguuccga

SEQ ID NO: 44318 - RNA, 22 nt, Homo sapiens
gcagaggaccuguccccucuca

SEQ ID NO: 44319 - RNA, 18 nt, Homo sapiens
ccuccaccucccaccucc

SEQ ID NO: 44320 - RNA, 18 nt, Homo sapiens
augcgcacccuguuccag

SEQ ID NO: 44321 - RNA, 20 nt, Homo sapiens
caccaguuucccuuuccuga

SEQ ID NO: 44322 - RNA, 18 nt, Homo sapiens
cucacccaaccugugaug

SEQ ID NO: 44323 - RNA, 17 nt, Homo sapiens
cuccuuuggggauggcc

SEQ ID NO: 44324 - RNA, 19 nt, Homo sapiens
uagaugggcuugacggagc

SEQ ID NO: 44325 - RNA, 16 nt, Homo sapiens
ucccacuguccccugu

SEQ ID NO: 44326 - RNA, 19 nt, Homo sapiens
ucuggaggaacccauugcu

SEQ ID NO: 44327 - RNA, 16 nt, Homo sapiens
acuggggaacugugac

SEQ ID NO: 44328 - RNA, 19 nt, Homo sapiens
agcacuugaaugcuuagcu

SEQ ID NO: 44329 - RNA, 29 nt, Homo sapiens
cguuccagccucucccuacucccauccca

SEQ ID NO: 44330 - RNA, 20 nt, Homo sapiens
gggcaagaugaaggcuucca

SEQ ID NO: 44331 - RNA, 18 nt, Homo sapiens
ggugaauggggaaggguc

SEQ ID NO: 44332 - RNA, 23 nt, Homo sapiens
uaagaaggggcuggugcccaguc

SEQ ID NO: 44333 - RNA, 22 nt, Homo sapiens
uauuaaauucauaccaucccua

SEQ ID NO: 44334 - RNA, 27 nt, Homo sapiens
ucuaucucccccgacuucuaccaggga

SEQ ID NO: 44335 - RNA, 21 nt, Homo sapiens
uguuccagagcucagccuucu

SEQ ID NO: 44336 - RNA, 21 nt, Homo sapiens
uuucacuugcauccaacuccu

SEQ ID NO: 44337 - RNA, 18 nt, Homo sapiens
ccauagcucaguccucca

SEQ ID NO: 44338 - RNA, 24 nt, Homo sapiens
aaugcaacugacccuuucaaucag

SEQ ID NO: 44339 - RNA, 18 nt, Homo sapiens
acuuagagggcuuuccaa

SEQ ID NO: 44340 - RNA, 18 nt, Homo sapiens
auuauuauguaccacaca

SEQ ID NO: 44341 - RNA, 17 nt, Homo sapiens
guugggcugugguuggc

SEQ ID NO: 44342 - RNA, 23 nt, Homo sapiens
ugagccugucuaagguggggcua

SEQ ID NO: 44343 - RNA, 27 nt, Homo sapiens
uuuuuuuauggcaagacuuuuggcuuu

SEQ ID NO: 44344 - RNA, 22 nt, Homo sapiens
aaccaccacaacuucuuauaca

SEQ ID NO: 44345 - RNA, 18 nt, Homo sapiens
ucuugugccaaacugaca

SEQ ID NO: 44346 - RNA, 19 nt, Homo sapiens
ugacacaacuucccagcuc

SEQ ID NO: 44347 - RNA, 20 nt, Homo sapiens
agcaagucauauugauauua

SEQ ID NO: 44348 - RNA, 22 nt, Homo sapiens
cagccugcccaguauagugaaa

SEQ ID NO: 44349 - RNA, 21 nt, Homo sapiens
ucacuaagagaacuuuuuaca

SEQ ID NO: 44350 - RNA, 24 nt, Homo sapiens
acccagucugcccuugggauucca

SEQ ID NO: 44351 - RNA, 22 nt, Homo sapiens
accccuuuccagccaaaguccc

SEQ ID NO: 44352 - RNA, 18 nt, Homo sapiens
agaagggggccugagaga

SEQ ID NO: 44353 - RNA, 21 nt, Homo sapiens
cacccuggaagccacugucaa

SEQ ID NO: 44354 - RNA, 20 nt, Homo sapiens
ccaagcccacucuucccuca

SEQ ID NO: 44355 - RNA, 20 nt, Homo sapiens
cccuccccaagcccuuccca

SEQ ID NO: 44356 - RNA, 24 nt, Homo sapiens
ccucaucaugagccucaacugccu

SEQ ID NO: 44357 - RNA, 20 nt, Homo sapiens
ccuccuccgaccccuuucca

SEQ ID NO: 44358 - RNA, 19 nt, Homo sapiens
cugggccugcuccuugcca

SEQ ID NO: 44359 - RNA, 18 nt, Homo sapiens
gccaaacagaauguaaca

SEQ ID NO: 44360 - RNA, 20 nt, Homo sapiens
gcccuucggagauucgggga

SEQ ID NO: 44361 - RNA, 15 nt, Homo sapiens
ucucuguccuucccu

SEQ ID NO: 44362 - RNA, 21 nt, Homo sapiens
uuccagaaguggaggcuccag

SEQ ID NO: 44363 - RNA, 20 nt, Homo sapiens
uucccucagcucacccuuca

SEQ ID NO: 44364 - RNA, 19 nt, Homo sapiens
augugacuugcuccucuuu

SEQ ID NO: 44365 - RNA, 18 nt, Homo sapiens
gaugugacuugcuccucu

SEQ ID NO: 44366 - RNA, 17 nt, Homo sapiens
uuuccugugcuguucuc

SEQ ID NO: 44367 - RNA, 20 nt, Homo sapiens
aagagaaaggagucagguuu

SEQ ID NO: 44368 - RNA, 24 nt, Homo sapiens
aguaacccuggacagaguggcagg

SEQ ID NO: 44369 - RNA, 25 nt, Homo sapiens
agugacuuucuucaaugccacaccc

SEQ ID NO: 44370 - RNA, 20 nt, Homo sapiens
gagaaguaacccuggacaga

SEQ ID NO: 44371 - RNA, 21 nt, Homo sapiens
gccacccugcgcaaccagccc

SEQ ID NO: 44372 - RNA, 19 nt, Homo sapiens
gccagcuggagcuggccca

SEQ ID NO: 44373 - RNA, 23 nt, Homo sapiens
uccucuuuuccccuggaaaccuc

SEQ ID NO: 44374 - RNA, 23 nt, Homo sapiens
uggacaccagccagcuggagcug

SEQ ID NO: 44375 - RNA, 19 nt, Homo sapiens
uugcacguguaccaagcuu

SEQ ID NO: 44376 - RNA, 23 nt, Homo sapiens
aacagaaagccugagaaccagcu

SEQ ID NO: 44377 - RNA, 22 nt, Homo sapiens
acagaaagccugagaaccagcu

SEQ ID NO: 44378 - RNA, 18 nt, Homo sapiens
aggccugcucucacuuua

SEQ ID NO: 44379 - RNA, 22 nt, Homo sapiens
cuuccgagccgcauguuacuca

SEQ ID NO: 44380 - RNA, 24 nt, Homo sapiens
gcugggugauucuccccugccucu

SEQ ID NO: 44381 - RNA, 18 nt, Homo sapiens
guguaggaguuuuuugga

SEQ ID NO: 44382 - RNA, 22 nt, Homo sapiens
uaugauuaggauaaccauauaa

SEQ ID NO: 44383 - RNA, 22 nt, Homo sapiens
uggaaacugaaaacagagguga

SEQ ID NO: 44384 - RNA, 17 nt, Homo sapiens
uuggggcaagucacuuu

SEQ ID NO: 44385 - RNA, 24 nt, Homo sapiens
gaaaccccuuuuuuucugucccuu

SEQ ID NO: 44386 - RNA, 21 nt, Homo sapiens
gaaccaagauuccuacugaca

SEQ ID NO: 44387 - RNA, 16 nt, Homo sapiens
augcuuccuccucuga

SEQ ID NO: 44388 - RNA, 22 nt, Homo sapiens
cucuuucccucccaauuuucca

SEQ ID NO: 44389 - RNA, 17 nt, Homo sapiens
gaguggaacuguggaac

SEQ ID NO: 44390 - RNA, 23 nt, Homo sapiens
ugcaauuuuuauucuuaaacuaa

SEQ ID NO: 44391 - RNA, 18 nt, Homo sapiens
uuauacuccagguagugu

SEQ ID NO: 44392 - RNA, 17 nt, Homo sapiens
caaaaacauguguugua

SEQ ID NO: 44393 - RNA, 21 nt, Homo sapiens
uaaaccagaggcacaauguac

SEQ ID NO: 44394 - RNA, 21 nt, Homo sapiens
ucuccugcuacauuccuuuuu

SEQ ID NO: 44395 - RNA, 18 nt, Homo sapiens
aaaccaaauuggacuauu

SEQ ID NO: 44396 - RNA, 18 nt, Homo sapiens
uacuuuucccucacugcc

SEQ ID NO: 44397 - RNA, 19 nt, Homo sapiens
caccaccgccaucgccuca

SEQ ID NO: 44398 - RNA, 19 nt, Homo sapiens
cauuucugggguucccgau

SEQ ID NO: 44399 - RNA, 16 nt, Homo sapiens
cugcucgcuuuguuuu

SEQ ID NO: 44400 - RNA, 17 nt, Homo sapiens
cuuucagggccugugag

SEQ ID NO: 44401 - RNA, 19 nt, Homo sapiens
gacagugcaucgaugcucc

SEQ ID NO: 44402 - RNA, 22 nt, Homo sapiens
gacagugcaucgaugcuccccc

SEQ ID NO: 44403 - RNA, 22 nt, Homo sapiens
gcucugaagacccaggccucac

SEQ ID NO: 44404 - RNA, 20 nt, Homo sapiens
ucuaaucagccugugugauu

SEQ ID NO: 44405 - RNA, 18 nt, Homo sapiens
agccacaugccccagcca

SEQ ID NO: 44406 - RNA, 19 nt, Homo sapiens
cccuuuuuccuguauugua

SEQ ID NO: 44407 - RNA, 22 nt, Homo sapiens
cuuccuaaucaaauucuucuca

SEQ ID NO: 44408 - RNA, 19 nt, Homo sapiens
ugucgccaacauggggaug

SEQ ID NO: 44409 - RNA, 17 nt, Homo sapiens
agcauccagcuucugug

SEQ ID NO: 44410 - RNA, 19 nt, Homo sapiens
aguuuaaucccccauucca

SEQ ID NO: 44411 - RNA, 19 nt, Homo sapiens
ccagcaagcgccgaucucc

SEQ ID NO: 44412 - RNA, 22 nt, Homo sapiens
cuagaagcccguuccccagugg

SEQ ID NO: 44413 - RNA, 22 nt, Homo sapiens
cuguucuacaaaaaguagggug

SEQ ID NO: 44414 - RNA, 24 nt, Homo sapiens
gccugggccgcggaguuugugucc

SEQ ID NO: 44415 - RNA, 18 nt, Homo sapiens
guuuaaucccccauucca

SEQ ID NO: 44416 - RNA, 22 nt, Homo sapiens
ugagcucuuuacgggagcauca

SEQ ID NO: 44417 - RNA, 21 nt, Homo sapiens
uuugaaaggagaaggaauugg

SEQ ID NO: 44418 - RNA, 24 nt, Homo sapiens
agaaagaugcaggacagcauuuca

SEQ ID NO: 44419 - RNA, 17 nt, Homo sapiens
caacuuguauauuuggc

SEQ ID NO: 44420 - RNA, 16 nt, Homo sapiens
cagccccucauggcca

SEQ ID NO: 44421 - RNA, 24 nt, Homo sapiens
cagcccuacccauugaucauuuca

SEQ ID NO: 44422 - RNA, 22 nt, Homo sapiens
uugaauguuuuugcuguuuuua

SEQ ID NO: 44423 - RNA, 17 nt, Homo sapiens
gcaaccucagccaauga

SEQ ID NO: 44424 - RNA, 16 nt, Homo sapiens
uccuuugaacauggga

SEQ ID NO: 44425 - RNA, 18 nt, Homo sapiens
uucugaugauggaauuuc

SEQ ID NO: 44426 - RNA, 27 nt, Homo sapiens
gcagucccucacuuugaaaccuucgca

SEQ ID NO: 44427 - RNA, 20 nt, Homo sapiens
auauccaugaaugcaauuug

SEQ ID NO: 44428 - RNA, 18 nt, Homo sapiens
cuguaguuuuaauuccuc

SEQ ID NO: 44429 - RNA, 19 nt, Homo sapiens
cuuugccauaguucagcua

SEQ ID NO: 44430 - RNA, 20 nt, Homo sapiens
aucgacaaaagaaccauuga

SEQ ID NO: 44431 - RNA, 16 nt, Homo sapiens
ggcgguggcaucgaca

SEQ ID NO: 44432 - RNA, 18 nt, Homo sapiens
uuggcuacaacccugaca

SEQ ID NO: 44433 - RNA, 17 nt, Homo sapiens
cucuccuucucucucug

SEQ ID NO: 44434 - RNA, 24 nt, Homo sapiens
gauugguaugguaauuuaaagcaa

SEQ ID NO: 44435 - RNA, 17 nt, Homo sapiens
uccuccgauggcuguga

SEQ ID NO: 44436 - RNA, 24 nt, Homo sapiens
agugggaaauuucagauuacuuuu

SEQ ID NO: 44437 - RNA, 18 nt, Homo sapiens
ugcuucaaguaauacuuc

SEQ ID NO: 44438 - RNA, 20 nt, Homo sapiens
ugguaaucaaugcauggcca

SEQ ID NO: 44439 - RNA, 24 nt, Homo sapiens
uuuagccuuucucaguuuauuuuu

SEQ ID NO: 44440 - RNA, 18 nt, Homo sapiens
aaagggugauccagacau

SEQ ID NO: 44441 - RNA, 19 nt, Homo sapiens
acauuucccccaaaacaaa

SEQ ID NO: 44442 - RNA, 18 nt, Homo sapiens
agagcacauuaagucuga

SEQ ID NO: 44443 - RNA, 18 nt, Homo sapiens
auuucccccaaaacaaaa

SEQ ID NO: 44444 - RNA, 21 nt, Homo sapiens
caagaaauccucaccagcagu

SEQ ID NO: 44445 - RNA, 18 nt, Homo sapiens
ucaccgacaguaccauca

SEQ ID NO: 44446 - RNA, 17 nt, Homo sapiens
uuuuguacaaaauaguc

SEQ ID NO: 44447 - RNA, 18 nt, Homo sapiens
cacagacagacaauaagc

SEQ ID NO: 44448 - RNA, 19 nt, Homo sapiens
cuguugaagguguucaugg

SEQ ID NO: 44449 - RNA, 20 nt, Homo sapiens
ggguuuaacaguuuuuguua

SEQ ID NO: 44450 - RNA, 19 nt, Homo sapiens
uagaaauugaauuagcaua

SEQ ID NO: 44451 - RNA, 21 nt, Homo sapiens
ucugagcagucuuguaauauu

SEQ ID NO: 44452 - RNA, 18 nt, Homo sapiens
aagaccucaaucauguca

SEQ ID NO: 44453 - RNA, 20 nt, Homo sapiens
gagagauaaacaagcauaca

SEQ ID NO: 44454 - RNA, 21 nt, Homo sapiens
caaaguuacuuugacugcauu

SEQ ID NO: 44455 - RNA, 21 nt, Homo sapiens
ccucuccccgaccuccuccca

SEQ ID NO: 44456 - RNA, 17 nt, Homo sapiens
cuggcuuucccuuucca

SEQ ID NO: 44457 - RNA, 23 nt, Homo sapiens
gucuugucgaaucgcugcagcag

SEQ ID NO: 44458 - RNA, 19 nt, Homo sapiens
acguagauucaggcaaguc

SEQ ID NO: 44459 - RNA, 20 nt, Homo sapiens
aucgacaaaagaaccauuga

SEQ ID NO: 44460 - RNA, 17 nt, Homo sapiens
agggccuggacaccccu

SEQ ID NO: 44461 - RNA, 21 nt, Homo sapiens
agggguucaaaccccaccuca

SEQ ID NO: 44462 - RNA, 18 nt, Homo sapiens
aguagguggaggggagcg

SEQ ID NO: 44463 - RNA, 27 nt, Homo sapiens
caagguugguagugaaugggccugguu

SEQ ID NO: 44464 - RNA, 21 nt, Homo sapiens
ccaauggugcuuuuggcuuua

SEQ ID NO: 44465 - RNA, 19 nt, Homo sapiens
ccacuucauauuuguuaua

SEQ ID NO: 44466 - RNA, 18 nt, Homo sapiens
ccccacaugucauggcaa

SEQ ID NO: 44467 - RNA, 25 nt, Homo sapiens
cccuucccccacccagagacugggc

SEQ ID NO: 44468 - RNA, 29 nt, Homo sapiens
gccuggccgcacccaaccuguguuguugc

SEQ ID NO: 44469 - RNA, 22 nt, Homo sapiens
ggcaugaccaaaccucagugga

SEQ ID NO: 44470 - RNA, 21 nt, Homo sapiens
ugaagagauccacauuuccuu

SEQ ID NO: 44471 - RNA, 20 nt, Homo sapiens
uucagucacuacagcuccga

SEQ ID NO: 44472 - RNA, 18 nt, Homo sapiens
agugacagucauguugaa

SEQ ID NO: 44473 - RNA, 17 nt, Homo sapiens
cggagcaccaccccggc

SEQ ID NO: 44474 - RNA, 24 nt, Homo sapiens
ccccgcccccaaucccccauagcu

SEQ ID NO: 44475 - RNA, 19 nt, Homo sapiens
ccuuuugaugcccuugaau

SEQ ID NO: 44476 - RNA, 22 nt, Homo sapiens
cgcgcgccauccguacccgggc

SEQ ID NO: 44477 - RNA, 21 nt, Homo sapiens
gggggaggguugcaagcgcca

SEQ ID NO: 44478 - RNA, 20 nt, Homo sapiens
ugcccaggugucccccccag

SEQ ID NO: 44479 - RNA, 18 nt, Homo sapiens
ugcucccaggcaacacug

SEQ ID NO: 44480 - RNA, 19 nt, Homo sapiens
cccaaguaugcuucaucuc

SEQ ID NO: 44481 - RNA, 25 nt, Homo sapiens
aaaugcaaagggacaaguauguguu

SEQ ID NO: 44482 - RNA, 19 nt, Homo sapiens
acaaacagggcagccagag

SEQ ID NO: 44483 - RNA, 18 nt, Homo sapiens
acccagcuuccaaggcug

SEQ ID NO: 44484 - RNA, 17 nt, Homo sapiens
acugucacguucugugg

SEQ ID NO: 44485 - RNA, 22 nt, Homo sapiens
caagaacagggcagcuuggacc

SEQ ID NO: 44486 - RNA, 24 nt, Homo sapiens
cagccugugguggagggucucugg

SEQ ID NO: 44487 - RNA, 21 nt, Homo sapiens
cgaggcugcagugggauguga

SEQ ID NO: 44488 - RNA, 18 nt, Homo sapiens
cuucauccauacccuucu

SEQ ID NO: 44489 - RNA, 18 nt, Homo sapiens
gagauuaaacagagguga

SEQ ID NO: 44490 - RNA, 18 nt, Homo sapiens
gcucccaggggccugcac

SEQ ID NO: 44491 - RNA, 21 nt, Homo sapiens
ugccggauuuugcuuccugca

SEQ ID NO: 44492 - RNA, 23 nt, Homo sapiens
ugcugugggcccagaagcgccca

SEQ ID NO: 44493 - RNA, 19 nt, Homo sapiens
uguggugauguuuuuggga

SEQ ID NO: 44494 - RNA, 22 nt, Homo sapiens
uucuaagaaaaacaaaauacaa

SEQ ID NO: 44495 - RNA, 19 nt, Homo sapiens
cgaccaccgcggccgccgg

SEQ ID NO: 44496 - RNA, 19 nt, Homo sapiens
cugaagacaugcucucaca

SEQ ID NO: 44497 - RNA, 17 nt, Homo sapiens
gaaaacacucugaugua

SEQ ID NO: 44498 - RNA, 19 nt, Homo sapiens
caggccguccccucccucu

SEQ ID NO: 44499 - RNA, 18 nt, Homo sapiens
ccuaacuccuuaucuuca

SEQ ID NO: 44500 - RNA, 20 nt, Homo sapiens
ccuuccccuccuuccuuucc

SEQ ID NO: 44501 - RNA, 19 nt, Homo sapiens
guggacagugccaccuccu

SEQ ID NO: 44502 - RNA, 17 nt, Homo sapiens
ugcccaaagccacuucu

SEQ ID NO: 44503 - RNA, 24 nt, Homo sapiens
uuuaaaauugucauuguuugguuu

SEQ ID NO: 44504 - RNA, 22 nt, Homo sapiens
uuuucgauacaacaucaugaca

SEQ ID NO: 44505 - RNA, 19 nt, Homo sapiens
cagaaaaauccauccgcca

SEQ ID NO: 44506 - RNA, 21 nt, Homo sapiens
gcaaugcucuuuaccacguuc

SEQ ID NO: 44507 - RNA, 21 nt, Homo sapiens
ucaucaucaucaucaucuucc

SEQ ID NO: 44508 - RNA, 18 nt, Homo sapiens
ccaguggccccacgaagc

SEQ ID NO: 44509 - RNA, 21 nt, Homo sapiens
cucugcuccgagggccagugg

SEQ ID NO: 44510 - RNA, 18 nt, Homo sapiens
guuccaguggccccacga

SEQ ID NO: 44511 - RNA, 22 nt, Homo sapiens
uaagaguaacagcagccaccgc

SEQ ID NO: 44512 - RNA, 19 nt, Homo sapiens
aaugaaauuaucaacuggc

SEQ ID NO: 44513 - RNA, 24 nt, Homo sapiens
cgcgcgcccuccaaccugcugcug

SEQ ID NO: 44514 - RNA, 27 nt, Homo sapiens
acauuaugucagauuauguacuugcua

SEQ ID NO: 44515 - RNA, 19 nt, Homo sapiens
auaacuuuuccuggcaaca

SEQ ID NO: 44516 - RNA, 22 nt, Homo sapiens
cacuuccucaucacugcagcca

SEQ ID NO: 44517 - RNA, 15 nt, Homo sapiens
cuccuucucaucuga

SEQ ID NO: 44518 - RNA, 20 nt, Homo sapiens
gaguuucuaccaagaucucc

SEQ ID NO: 44519 - RNA, 23 nt, Homo sapiens
gcauaacaaauaaacucuaagcu

SEQ ID NO: 44520 - RNA, 22 nt, Homo sapiens
gcuauuguucccugguguuaga

SEQ ID NO: 44521 - RNA, 23 nt, Homo sapiens
acagcgagggccuguacuaccuc

SEQ ID NO: 44522 - RNA, 19 nt, Homo sapiens
agccgcagccucccggcgg

SEQ ID NO: 44523 - RNA, 16 nt, Homo sapiens
aggccccaagccuuca

SEQ ID NO: 44524 - RNA, 20 nt, Homo sapiens
gacgugcagacggugucgca

SEQ ID NO: 44525 - RNA, 18 nt, Homo sapiens
ggagccggcccaagccca

SEQ ID NO: 44526 - RNA, 22 nt, Homo sapiens
uaaaacugugaaaaauagcuau

SEQ ID NO: 44527 - RNA, 18 nt, Homo sapiens
uggacgaaaaugacgugc

SEQ ID NO: 44528 - RNA, 18 nt, Homo sapiens
agagauugagacaaaaug

SEQ ID NO: 44529 - RNA, 20 nt, Homo sapiens
ucaaagacuacucauuucca

SEQ ID NO: 44530 - RNA, 25 nt, Homo sapiens
uggauagagugaaucacaccuguaa

SEQ ID NO: 44531 - RNA, 20 nt, Homo sapiens
ccaugaauggcaccaugaca

SEQ ID NO: 44532 - RNA, 22 nt, Homo sapiens
cccuccccuuccuccucugcca

SEQ ID NO: 44533 - RNA, 24 nt, Homo sapiens
cccuggucugggaguggccugugg

SEQ ID NO: 44534 - RNA, 19 nt, Homo sapiens
cuccccuuccuccucugcc

SEQ ID NO: 44535 - RNA, 17 nt, Homo sapiens
ggccauucuccugagcu

SEQ ID NO: 44536 - RNA, 21 nt, Homo sapiens
uguguucucguccccuggacu

SEQ ID NO: 44537 - RNA, 21 nt, Homo sapiens
gcacucuuacccuccuucuca

SEQ ID NO: 44538 - RNA, 19 nt, Homo sapiens
acgcuuccaucuuuaucca

SEQ ID NO: 44539 - RNA, 18 nt, Homo sapiens
gucauuucucucaccucu

SEQ ID NO: 44540 - RNA, 23 nt, Homo sapiens
uaaauggacuaaugaugggauug

SEQ ID NO: 44541 - RNA, 20 nt, Homo sapiens
uaucuucuucuuauucuuca

SEQ ID NO: 44542 - RNA, 23 nt, Homo sapiens
ucugucuuuccaauguugcuuuu

SEQ ID NO: 44543 - RNA, 23 nt, Homo sapiens
ugaagaaacaaggaguaaaccca

SEQ ID NO: 44544 - RNA, 24 nt, Homo sapiens
agucuucauuucuuuauauuguca

SEQ ID NO: 44545 - RNA, 21 nt, Homo sapiens
ccaaaguuauauuuuauuuga

SEQ ID NO: 44546 - RNA, 19 nt, Homo sapiens
ccagagagguuuuccuaca

SEQ ID NO: 44547 - RNA, 23 nt, Homo sapiens
ucagcauuguguaguguuuucua

SEQ ID NO: 44548 - RNA, 21 nt, Homo sapiens
ugagaguuuaucuuuaccuca

SEQ ID NO: 44549 - RNA, 19 nt, Homo sapiens
augugauaacacagaucuu

SEQ ID NO: 44550 - RNA, 23 nt, Homo sapiens
gacuucaucagaaaauuuuguca

SEQ ID NO: 44551 - RNA, 21 nt, Homo sapiens
gcugagagagauggggucuca

SEQ ID NO: 44552 - RNA, 21 nt, Homo sapiens
aacagagacccugccucgaca

SEQ ID NO: 44553 - RNA, 18 nt, Homo sapiens
caacaaaaaaauuccuag

SEQ ID NO: 44554 - RNA, 21 nt, Homo sapiens
ccaacauuuaaaaagaugcga

SEQ ID NO: 44555 - RNA, 24 nt, Homo sapiens
ccgggguacagagaccugaccuca

SEQ ID NO: 44556 - RNA, 20 nt, Homo sapiens
cuguuuugugaagcauccca

SEQ ID NO: 44557 - RNA, 25 nt, Homo sapiens
aaguaucucaucgaaaaggcuccug

SEQ ID NO: 44558 - RNA, 23 nt, Homo sapiens
caccccgcagcccacguguggca

SEQ ID NO: 44559 - RNA, 21 nt, Homo sapiens
aacagcugcaggcuccaaaga

SEQ ID NO: 44560 - RNA, 16 nt, Homo sapiens
cuguucuguuuuguuu

SEQ ID NO: 44561 - RNA, 22 nt, Homo sapiens
cuucuugauugagguagcauga

SEQ ID NO: 44562 - RNA, 22 nt, Homo sapiens
ucugagcagagccaccauuuuu

SEQ ID NO: 44563 - RNA, 21 nt, Homo sapiens
ugacauuuuccuggccaguga

SEQ ID NO: 44564 - RNA, 20 nt, Homo sapiens
cacaggcuacagcugagcaa

SEQ ID NO: 44565 - RNA, 20 nt, Homo sapiens
ccugagguagucaggucauu

SEQ ID NO: 44566 - RNA, 16 nt, Homo sapiens
cuagaggagucccauc

SEQ ID NO: 44567 - RNA, 25 nt, Homo sapiens
cuuugggaucuaagugugguuugug

SEQ ID NO: 44568 - RNA, 20 nt, Homo sapiens
gguagucaggucauuguuuc

SEQ ID NO: 44569 - RNA, 17 nt, Homo sapiens
uccuugcguaguccuca

SEQ ID NO: 44570 - RNA, 20 nt, Homo sapiens
uguugguucucaucuuugaa

SEQ ID NO: 44571 - RNA, 22 nt, Homo sapiens
ccaccagucccagaacccgcca

SEQ ID NO: 44572 - RNA, 20 nt, Homo sapiens
cccaggcagcugcugccuca

SEQ ID NO: 44573 - RNA, 16 nt, Homo sapiens
gguccagcuccucccu

SEQ ID NO: 44574 - RNA, 21 nt, Homo sapiens
aagcaucgaaaugggaugucu

SEQ ID NO: 44575 - RNA, 20 nt, Homo sapiens
caucugcauccccgagccca

SEQ ID NO: 44576 - RNA, 23 nt, Homo sapiens
ccaacgcgcaguguguauuugca

SEQ ID NO: 44577 - RNA, 18 nt, Homo sapiens
cucucugucaucuccccu

SEQ ID NO: 44578 - RNA, 22 nt, Homo sapiens
ugaauggaaaaauaugaaagua

SEQ ID NO: 44579 - RNA, 22 nt, Homo sapiens
uggcuucucugaccuggagcug

SEQ ID NO: 44580 - RNA, 19 nt, Homo sapiens
agccacaaggaacaguucu

SEQ ID NO: 44581 - RNA, 16 nt, Homo sapiens
uacaguuagcagaccc

SEQ ID NO: 44582 - RNA, 23 nt, Homo sapiens
ucuuuuuguaacaccuuaauuuu

SEQ ID NO: 44583 - RNA, 20 nt, Homo sapiens
uggagauggauaugagacua

SEQ ID NO: 44584 - RNA, 23 nt, Homo sapiens
aaucagcacuuacuaaacaucaa

SEQ ID NO: 44585 - RNA, 18 nt, Homo sapiens
accacaauacaucagaga

SEQ ID NO: 44586 - RNA, 18 nt, Homo sapiens
agagaacacacacaaggg

SEQ ID NO: 44587 - RNA, 20 nt, Homo sapiens
augaagcaaacacacguagg

SEQ ID NO: 44588 - RNA, 19 nt, Homo sapiens
caacauagaggaaacccuu

SEQ ID NO: 44589 - RNA, 21 nt, Homo sapiens
cagaaggcagaaauccuguga

SEQ ID NO: 44590 - RNA, 22 nt, Homo sapiens
cagccacaguucaucuaucaua

SEQ ID NO: 44591 - RNA, 16 nt, Homo sapiens
ccuaugcauguaguga

SEQ ID NO: 44592 - RNA, 19 nt, Homo sapiens
cuacagccuccucaucuca

SEQ ID NO: 44593 - RNA, 19 nt, Homo sapiens
ggucuucaaguugcagcaa

SEQ ID NO: 44594 - RNA, 22 nt, Homo sapiens
ucaccuucuuggacucguucca

SEQ ID NO: 44595 - RNA, 20 nt, Homo sapiens
ucgugggcccgcacuucaua

SEQ ID NO: 44596 - RNA, 18 nt, Homo sapiens
uuauuaguaauagaagcu

SEQ ID NO: 44597 - RNA, 19 nt, Homo sapiens
agcucaugucagccagguc

SEQ ID NO: 44598 - RNA, 24 nt, Homo sapiens
ccauugcagagagacuccauccca

SEQ ID NO: 44599 - RNA, 21 nt, Homo sapiens
gugcugugcagcaaggagccc

SEQ ID NO: 44600 - RNA, 19 nt, Homo sapiens
acacauacauacacacaca

SEQ ID NO: 44601 - RNA, 19 nt, Homo sapiens
cagaacuugaauccuuuaa

SEQ ID NO: 44602 - RNA, 18 nt, Homo sapiens
ccaaguuuccuuguuccu

SEQ ID NO: 44603 - RNA, 22 nt, Homo sapiens
cggaggagggggcggggcucuc

SEQ ID NO: 44604 - RNA, 21 nt, Homo sapiens
ugguguuuggcgcuggaauua

SEQ ID NO: 44605 - RNA, 20 nt, Homo sapiens
aucaaaaaagccacuggaga

SEQ ID NO: 44606 - RNA, 17 nt, Homo sapiens
agaacauagagauaggg

SEQ ID NO: 44607 - RNA, 22 nt, Homo sapiens
agaacaugaagaaaugacccca

SEQ ID NO: 44608 - RNA, 17 nt, Homo sapiens
augagaacaccacacca

SEQ ID NO: 44609 - RNA, 17 nt, Homo sapiens
augagaacaccacacca

SEQ ID NO: 44610 - RNA, 17 nt, Homo sapiens
augagaacaccacacca

SEQ ID NO: 44611 - RNA, 17 nt, Homo sapiens
augagaacaccacacca

SEQ ID NO: 44612 - RNA, 17 nt, Homo sapiens
augagaacaccacacca

SEQ ID NO: 44613 - RNA, 17 nt, Homo sapiens
augagaacaccacauca

SEQ ID NO: 44614 - RNA, 19 nt, Homo sapiens
caccacaccauccccagca

SEQ ID NO: 44615 - RNA, 20 nt, Homo sapiens
ccaugagggggaggcugcca

SEQ ID NO: 44616 - RNA, 20 nt, Homo sapiens
gaagaaaacuccagcaacca

SEQ ID NO: 44617 - RNA, 19 nt, Homo sapiens
guaucaagaaggccugcca

SEQ ID NO: 44618 - RNA, 18 nt, Homo sapiens
uuuggcuacacuugugaa

SEQ ID NO: 44619 - RNA, 18 nt, Homo sapiens
cugggacccgugcgggga

SEQ ID NO: 44620 - RNA, 21 nt, Homo sapiens
acaauaaugaggccagaagua

SEQ ID NO: 44621 - RNA, 21 nt, Homo sapiens
augcgucacaugggcauuuca

SEQ ID NO: 44622 - RNA, 18 nt, Homo sapiens
cccgcgcugcgcgcccgg

SEQ ID NO: 44623 - RNA, 20 nt, Homo sapiens
uaucaccuuauuuuaucgaa

SEQ ID NO: 44624 - RNA, 20 nt, Homo sapiens
guuaugacuuggacuggaca

SEQ ID NO: 44625 - RNA, 16 nt, Homo sapiens
accacagcagugaugc

SEQ ID NO: 44626 - RNA, 18 nt, Homo sapiens
cagcagugaugccagcug

SEQ ID NO: 44627 - RNA, 17 nt, Homo sapiens
ccaccuugucacccuca

SEQ ID NO: 44628 - RNA, 22 nt, Homo sapiens
ccccugcugugucccauccccc

SEQ ID NO: 44629 - RNA, 24 nt, Homo sapiens
cuguuucaccccugcuguguccca

SEQ ID NO: 44630 - RNA, 18 nt, Homo sapiens
gacccaagggucccugga

SEQ ID NO: 44631 - RNA, 19 nt, Homo sapiens
gcagugaugccagcugggc

SEQ ID NO: 44632 - RNA, 21 nt, Homo sapiens
uuccagagacgguguuuccag

SEQ ID NO: 44633 - RNA, 22 nt, Homo sapiens
ccacugcuccuucuaacauuuu

SEQ ID NO: 44634 - RNA, 17 nt, Homo sapiens
ccgucucccggguucaa

SEQ ID NO: 44635 - RNA, 20 nt, Homo sapiens
ccuaagcguccuuuacauua

SEQ ID NO: 44636 - RNA, 21 nt, Homo sapiens
ccuugggagagagggcuucgg

SEQ ID NO: 44637 - RNA, 19 nt, Homo sapiens
guggacagcagccacccuu

SEQ ID NO: 44638 - RNA, 21 nt, Homo sapiens
ugaugcacacaccaaguggua

SEQ ID NO: 44639 - RNA, 23 nt, Homo sapiens
uucuaacguuuuuucaucauagu

SEQ ID NO: 44640 - RNA, 24 nt, Homo sapiens
ucuaaacaggcuuaaugauucuuc

SEQ ID NO: 44641 - RNA, 22 nt, Homo sapiens
ugaguaaucuuguaagcauuaa

SEQ ID NO: 44642 - RNA, 20 nt, Homo sapiens
uugccagaaucauuaccugu

SEQ ID NO: 44643 - RNA, 18 nt, Homo sapiens
agaaaaaccuuuauuugg

SEQ ID NO: 44644 - RNA, 22 nt, Homo sapiens
auauucauucuuguuucacaaa

SEQ ID NO: 44645 - RNA, 25 nt, Homo sapiens
gauuuuuuuuuaauugcaaagacua

SEQ ID NO: 44646 - RNA, 21 nt, Homo sapiens
ucuugcuguugccuuauuuuu

SEQ ID NO: 44647 - RNA, 22 nt, Homo sapiens
uugcuguugccuuauuuuugau

SEQ ID NO: 44648 - RNA, 21 nt, Homo sapiens
aggcacuuaggccucgccucc

SEQ ID NO: 44649 - RNA, 22 nt, Homo sapiens
aguuggugccguuggugccgcc

SEQ ID NO: 44650 - RNA, 18 nt, Homo sapiens
cgccgcuaucgcacggga

SEQ ID NO: 44651 - RNA, 21 nt, Homo sapiens
gccuaccauggucacccauga

SEQ ID NO: 44652 - RNA, 19 nt, Homo sapiens
ugcgcccggcucccggggg

SEQ ID NO: 44653 - RNA, 19 nt, Homo sapiens
uggcugcacauauaccuua

SEQ ID NO: 44654 - RNA, 21 nt, Homo sapiens
accccagaagcccugaccuca

SEQ ID NO: 44655 - RNA, 18 nt, Homo sapiens
caccaccacccacugccc

SEQ ID NO: 44656 - RNA, 23 nt, Homo sapiens
ccucauuugggcaccuugcuguc

SEQ ID NO: 44657 - RNA, 18 nt, Homo sapiens
ccuggcgguccuuggccu

SEQ ID NO: 44658 - RNA, 24 nt, Homo sapiens
ggcacaaaagccgguguccaggga

SEQ ID NO: 44659 - RNA, 16 nt, Homo sapiens
agggcuacauccagca

SEQ ID NO: 44660 - RNA, 26 nt, Homo sapiens
caauuuuuuaagaugaagaaguggga

SEQ ID NO: 44661 - RNA, 21 nt, Homo sapiens
ccucccccuuuccuucucucc

SEQ ID NO: 44662 - RNA, 20 nt, Homo sapiens
gcccaccccacccaagauuc

SEQ ID NO: 44663 - RNA, 25 nt, Homo sapiens
ggaaaaggaaaugcgcuccccucca

SEQ ID NO: 44664 - RNA, 19 nt, Homo sapiens
uugcaguauacaagcuuuu

SEQ ID NO: 44665 - RNA, 21 nt, Homo sapiens
cugccugggucuccucccuca

SEQ ID NO: 44666 - RNA, 19 nt, Homo sapiens
gcucggugacucacgucug

SEQ ID NO: 44667 - RNA, 18 nt, Homo sapiens
gugcuuuggucacaaagc

SEQ ID NO: 44668 - RNA, 25 nt, Homo sapiens
uaagaggaacggcugggaucaguua

SEQ ID NO: 44669 - RNA, 18 nt, Homo sapiens
uggagaugccucccucca

SEQ ID NO: 44670 - RNA, 19 nt, Homo sapiens
uuucugaucaauuaucggc

SEQ ID NO: 44671 - RNA, 20 nt, Homo sapiens
ccuucccagcaaggauauca

SEQ ID NO: 44672 - RNA, 20 nt, Homo sapiens
gcaaggauaucacacuccua

SEQ ID NO: 44673 - RNA, 18 nt, Homo sapiens
uauguggagaaacauuuu

SEQ ID NO: 44674 - RNA, 23 nt, Homo sapiens
ucaggucuucccauuuugccuca

SEQ ID NO: 44675 - RNA, 19 nt, Homo sapiens
uuuacauugucagagugaa

SEQ ID NO: 44676 - RNA, 17 nt, Homo sapiens
aaggcagcaagcaaggc

SEQ ID NO: 44677 - RNA, 20 nt, Homo sapiens
aguccuccaagaagaugcca

SEQ ID NO: 44678 - RNA, 18 nt, Homo sapiens
cauugucuccuccuuaga

SEQ ID NO: 44679 - RNA, 16 nt, Homo sapiens
ugccucgcugaaaagu

SEQ ID NO: 44680 - RNA, 18 nt, Homo sapiens
acguuccaaauacauuau

SEQ ID NO: 44681 - RNA, 18 nt, Homo sapiens
cugccuugccggccugcu

SEQ ID NO: 44682 - RNA, 21 nt, Homo sapiens
gguucugacucugucacccag

SEQ ID NO: 44683 - RNA, 19 nt, Homo sapiens
ucagugggguucaccuuca

SEQ ID NO: 44684 - RNA, 20 nt, Homo sapiens
aaacacugucaaggauuuca

SEQ ID NO: 44685 - RNA, 18 nt, Homo sapiens
acguuccaaauacauuau

SEQ ID NO: 44686 - RNA, 18 nt, Homo sapiens
cugccuugccggccugcu

SEQ ID NO: 44687 - RNA, 24 nt, Homo sapiens
gagcucucuauucuguuucauuga

SEQ ID NO: 44688 - RNA, 21 nt, Homo sapiens
gguucugacucugucacccag

SEQ ID NO: 44689 - RNA, 19 nt, Homo sapiens
ucagugggguucaccuuca

SEQ ID NO: 44690 - RNA, 18 nt, Homo sapiens
uuugcuauuuauucuugu

SEQ ID NO: 44691 - RNA, 18 nt, Homo sapiens
aacaagauaaaaaauaca

SEQ ID NO: 44692 - RNA, 20 nt, Homo sapiens
ccucugccucccagguucaa

SEQ ID NO: 44693 - RNA, 18 nt, Homo sapiens
gcuguaauuagagucaug

SEQ ID NO: 44694 - RNA, 25 nt, Homo sapiens
uccuaauuuaggcccucccaacgaa

SEQ ID NO: 44695 - RNA, 19 nt, Homo sapiens
uuauuaugucaccuuuccu

SEQ ID NO: 44696 - RNA, 21 nt, Homo sapiens
accagaugaaaccucuccagg

SEQ ID NO: 44697 - RNA, 20 nt, Homo sapiens
auccugugcaguuuacaaca

SEQ ID NO: 44698 - RNA, 18 nt, Homo sapiens
cuccuccuccucuuccuc

SEQ ID NO: 44699 - RNA, 23 nt, Homo sapiens
gccccgcugccccccuccuccuc

SEQ ID NO: 44700 - RNA, 17 nt, Homo sapiens
gcgcacgaucuccgggu

SEQ ID NO: 44701 - RNA, 21 nt, Homo sapiens
cugaccaggcuagaccacacg

SEQ ID NO: 44702 - RNA, 20 nt, Homo sapiens
gcccgcuuccccaacaccuc

SEQ ID NO: 44703 - RNA, 21 nt, Homo sapiens
ugugcgacuucaggcauauca

SEQ ID NO: 44704 - RNA, 19 nt, Homo sapiens
agaaucucaacgugcugua

SEQ ID NO: 44705 - RNA, 22 nt, Homo sapiens
agaggggaugaaucauuucagg

SEQ ID NO: 44706 - RNA, 22 nt, Homo sapiens
ugagaucauggcuaggaaacgg

SEQ ID NO: 44707 - RNA, 19 nt, Homo sapiens
ugggaccagcacggggcug

SEQ ID NO: 44708 - RNA, 20 nt, Homo sapiens
ccauccuaggcaaaaacucc

SEQ ID NO: 44709 - RNA, 20 nt, Homo sapiens
gccggauaguacgcuuccua

SEQ ID NO: 44710 - RNA, 22 nt, Homo sapiens
gcgucgugguagcuaccacgcu

SEQ ID NO: 44711 - RNA, 18 nt, Homo sapiens
ggccacgacaacaucaca

SEQ ID NO: 44712 - RNA, 22 nt, Homo sapiens
guauguauggcgcuuugguuga

SEQ ID NO: 44713 - RNA, 20 nt, Homo sapiens
uucaagacuagccugaccaa

SEQ ID NO: 44714 - RNA, 26 nt, Homo sapiens
agaaaggcagcucccuucaccuuccc

SEQ ID NO: 44715 - RNA, 19 nt, Homo sapiens
aggagagaaaggcagcucc

SEQ ID NO: 44716 - RNA, 19 nt, Homo sapiens
aguucaacaaagccuucua

SEQ ID NO: 44717 - RNA, 16 nt, Homo sapiens
augucugguccucuga

SEQ ID NO: 44718 - RNA, 20 nt, Homo sapiens
cggcgggucacgacaucggc

SEQ ID NO: 44719 - RNA, 18 nt, Homo sapiens
uccgaaacugaagacucu

SEQ ID NO: 44720 - RNA, 19 nt, Homo sapiens
cugcaaccucugccuccca

SEQ ID NO: 44721 - RNA, 22 nt, Homo sapiens
guauauagauuauuuucgauua

SEQ ID NO: 44722 - RNA, 18 nt, Homo sapiens
uaaguggaucucaccaga

SEQ ID NO: 44723 - RNA, 23 nt, Homo sapiens
aaaacaaaaaggauuacccaaac

SEQ ID NO: 44724 - RNA, 22 nt, Homo sapiens
aaacaguuccagcaggcucucu

SEQ ID NO: 44725 - RNA, 18 nt, Homo sapiens
aagaggaaugguacuaca

SEQ ID NO: 44726 - RNA, 23 nt, Homo sapiens
agcuucuggugcuuaaccacauc

SEQ ID NO: 44727 - RNA, 19 nt, Homo sapiens
gcccugugauuuuuuuuaa

SEQ ID NO: 44728 - RNA, 19 nt, Homo sapiens
uaauccaugagagguguuu

SEQ ID NO: 44729 - RNA, 20 nt, Homo sapiens
ugaauggacuucuuaagcug

SEQ ID NO: 44730 - RNA, 21 nt, Homo sapiens
uguuuugagcuuuugacuaau

SEQ ID NO: 44731 - RNA, 17 nt, Homo sapiens
acuuaggagguauuaca

SEQ ID NO: 44732 - RNA, 18 nt, Homo sapiens
aguccuuaggaacagaua

SEQ ID NO: 44733 - RNA, 22 nt, Homo sapiens
cauuuuuacagcuacccugauu

SEQ ID NO: 44734 - RNA, 17 nt, Homo sapiens
gaauaaauuacugcuuu

SEQ ID NO: 44735 - RNA, 23 nt, Homo sapiens
gaggcuagaaguuccgcuugcca

SEQ ID NO: 44736 - RNA, 22 nt, Homo sapiens
acacauuauuaggccuuugcca

SEQ ID NO: 44737 - RNA, 17 nt, Homo sapiens
ucugaaaacaccagucu

SEQ ID NO: 44738 - RNA, 19 nt, Homo sapiens
gcagccaucaacugccucu

SEQ ID NO: 44739 - RNA, 19 nt, Homo sapiens
ucuauugcagagcacagca

SEQ ID NO: 44740 - RNA, 17 nt, Homo sapiens
ugcaaaugacuaguuca

SEQ ID NO: 44741 - RNA, 17 nt, Homo sapiens
ugggaacgccgcuccag

SEQ ID NO: 44742 - RNA, 21 nt, Homo sapiens
uuaguauucuuuuuuuucuca

SEQ ID NO: 44743 - RNA, 18 nt, Homo sapiens
uacugacaccacagcagu

SEQ ID NO: 44744 - RNA, 17 nt, Homo sapiens
caaauccacaguauacu

SEQ ID NO: 44745 - RNA, 19 nt, Homo sapiens
uuugucaacaccaauuaca

SEQ ID NO: 44746 - RNA, 16 nt, Homo sapiens
ucuagaaaaccagcuu

SEQ ID NO: 44747 - RNA, 18 nt, Homo sapiens
uuccagaaacggugcucc

SEQ ID NO: 44748 - RNA, 20 nt, Homo sapiens
uaacugugaaauacucucca

SEQ ID NO: 44749 - RNA, 18 nt, Homo sapiens
aguaagauguccucuuuc

SEQ ID NO: 44750 - RNA, 19 nt, Homo sapiens
aguccuguugguugaguca

SEQ ID NO: 44751 - RNA, 20 nt, Homo sapiens
auccaaugccucgagcccac

SEQ ID NO: 44752 - RNA, 20 nt, Homo sapiens
cauccaaugccucgagccca

SEQ ID NO: 44753 - RNA, 18 nt, Homo sapiens
cugggcagcugucugccu

SEQ ID NO: 44754 - RNA, 17 nt, Homo sapiens
cugggccucccuggcuu

SEQ ID NO: 44755 - RNA, 18 nt, Homo sapiens
gcaagugccccugcuuca

SEQ ID NO: 44756 - RNA, 21 nt, Homo sapiens
gccucucuacggcucugcuuc

SEQ ID NO: 44757 - RNA, 20 nt, Homo sapiens
gcgccccggcagucaggaua

SEQ ID NO: 44758 - RNA, 19 nt, Homo sapiens
ucaagugccauuccugcaa

SEQ ID NO: 44759 - RNA, 19 nt, Homo sapiens
ugccucugucggagacuag

SEQ ID NO: 44760 - RNA, 22 nt, Homo sapiens
acagaaauuuuagcucuuuucu

SEQ ID NO: 44761 - RNA, 21 nt, Homo sapiens
cgggucggcguugggcucagu

SEQ ID NO: 44762 - RNA, 25 nt, Homo sapiens
cuuuggaaaguaguuguuuaacuuu

SEQ ID NO: 44763 - RNA, 18 nt, Homo sapiens
gaccagcacucccuccca

SEQ ID NO: 44764 - RNA, 19 nt, Homo sapiens
gccgcggugggggacccgg

SEQ ID NO: 44765 - RNA, 20 nt, Homo sapiens
gccugaauuucugcuugguu

SEQ ID NO: 44766 - RNA, 19 nt, Homo sapiens
uccuuuaaaaaauauuugg

SEQ ID NO: 44767 - RNA, 18 nt, Homo sapiens
gagagagagaaaaaaccu

SEQ ID NO: 44768 - RNA, 21 nt, Homo sapiens
uccugaggaaauuauccgaga

SEQ ID NO: 44769 - RNA, 20 nt, Homo sapiens
uaugcuaagaugauuauuau

SEQ ID NO: 44770 - RNA, 20 nt, Homo sapiens
acacagugugcucucuaguu

SEQ ID NO: 44771 - RNA, 23 nt, Homo sapiens
uuugcaucgcuugagucauuuuu

SEQ ID NO: 44772 - RNA, 20 nt, Homo sapiens
gaccagccacagaaccagcu

SEQ ID NO: 44773 - RNA, 24 nt, Homo sapiens
ucacugagcaaaggagcaacuguc

SEQ ID NO: 44774 - RNA, 20 nt, Homo sapiens
agguaacccagaaucuccca

SEQ ID NO: 44775 - RNA, 18 nt, Homo sapiens
uuuucucagagaaguucc

SEQ ID NO: 44776 - RNA, 24 nt, Homo sapiens
accagcagccaucccuuucccucu

SEQ ID NO: 44777 - RNA, 18 nt, Homo sapiens
aaacaaucaaauguaaua

SEQ ID NO: 44778 - RNA, 18 nt, Homo sapiens
agaguauguuaucaccuc

SEQ ID NO: 44779 - RNA, 22 nt, Homo sapiens
gaaaaaaauccaagacaaguua

SEQ ID NO: 44780 - RNA, 21 nt, Homo sapiens
uggcaaccugccuucuggcca

SEQ ID NO: 44781 - RNA, 21 nt, Homo sapiens
aucgugggcaucgucuggcuc

SEQ ID NO: 44782 - RNA, 16 nt, Homo sapiens
cauguaccugaugcgg

SEQ ID NO: 44783 - RNA, 16 nt, Homo sapiens
ccaaggauccucacca

SEQ ID NO: 44784 - RNA, 24 nt, Homo sapiens
ccauccucuccuuccuucugcgcc

SEQ ID NO: 44785 - RNA, 21 nt, Homo sapiens
cgggaucgugguguuccggcg

SEQ ID NO: 44786 - RNA, 22 nt, Homo sapiens
cucugggcccugggaucuggaa

SEQ ID NO: 44787 - RNA, 24 nt, Homo sapiens
gccucucaugcugccuccucugcc

SEQ ID NO: 44788 - RNA, 20 nt, Homo sapiens
ucugacaagcaccguggcca

SEQ ID NO: 44789 - RNA, 22 nt, Homo sapiens
ugcccauggguccugggcaccc

SEQ ID NO: 44790 - RNA, 19 nt, Homo sapiens
ugugaccaccccagcugca

SEQ ID NO: 44791 - RNA, 18 nt, Homo sapiens
uucuggcccccggcuccc

SEQ ID NO: 44792 - RNA, 20 nt, Homo sapiens
acuagggagaugacugagaa

SEQ ID NO: 44793 - RNA, 19 nt, Homo sapiens
aucugugaguuauugucac

SEQ ID NO: 44794 - RNA, 20 nt, Homo sapiens
augcugucucugcaguacug

SEQ ID NO: 44795 - RNA, 17 nt, Homo sapiens
cagcaacaagguaccau

SEQ ID NO: 44796 - RNA, 22 nt, Homo sapiens
gaagaaaaguuugaaaccauga

SEQ ID NO: 44797 - RNA, 18 nt, Homo sapiens
ggacucagcagacaccaa

SEQ ID NO: 44798 - RNA, 19 nt, Homo sapiens
aaacacauaucaagaucca

SEQ ID NO: 44799 - RNA, 19 nt, Homo sapiens
agucauuuccacagccuca

SEQ ID NO: 44800 - RNA, 17 nt, Homo sapiens
gcaaccucagccaguga

SEQ ID NO: 44801 - RNA, 17 nt, Homo sapiens
aacccagccccggguca

SEQ ID NO: 44802 - RNA, 18 nt, Homo sapiens
acugccuguggcacccau

SEQ ID NO: 44803 - RNA, 21 nt, Homo sapiens
auccagaagagcagaaggcua

SEQ ID NO: 44804 - RNA, 20 nt, Homo sapiens
ccaccucagcucccaccucc

SEQ ID NO: 44805 - RNA, 23 nt, Homo sapiens
ccuuaaaguuguaagccuuuaaa

SEQ ID NO: 44806 - RNA, 19 nt, Homo sapiens
ccuuagaaaaaagcagucc

SEQ ID NO: 44807 - RNA, 21 nt, Homo sapiens
gacccuggcaagcggagaagc

SEQ ID NO: 44808 - RNA, 20 nt, Homo sapiens
gcuccgggaacagagugggg

SEQ ID NO: 44809 - RNA, 18 nt, Homo sapiens
ggaccagccacuuccucu

SEQ ID NO: 44810 - RNA, 18 nt, Homo sapiens
gggauccugggccuguua

SEQ ID NO: 44811 - RNA, 19 nt, Homo sapiens
uagugcuugaagccucuca

SEQ ID NO: 44812 - RNA, 21 nt, Homo sapiens
ugaacccaccaucuuccugcu

SEQ ID NO: 44813 - RNA, 24 nt, Homo sapiens
uggguggacuccgguaggccagcu

SEQ ID NO: 44814 - RNA, 21 nt, Homo sapiens
cagugagagaccaagaaccca

SEQ ID NO: 44815 - RNA, 21 nt, Homo sapiens
ccaacagcaguuggggugucc

SEQ ID NO: 44816 - RNA, 18 nt, Homo sapiens
aaucucauucauuccuaa

SEQ ID NO: 44817 - RNA, 23 nt, Homo sapiens
accagcacugugucccucccccu

SEQ ID NO: 44818 - RNA, 21 nt, Homo sapiens
cauugacccucuccuuuccca

SEQ ID NO: 44819 - RNA, 24 nt, Homo sapiens
cccaacucccuucucaacaugggg

SEQ ID NO: 44820 - RNA, 22 nt, Homo sapiens
ccucuucccaacucccuucuca

SEQ ID NO: 44821 - RNA, 17 nt, Homo sapiens
cuuccccagcucccucc

SEQ ID NO: 44822 - RNA, 20 nt, Homo sapiens
ucaguuccucuccuguuccu

SEQ ID NO: 44823 - RNA, 24 nt, Homo sapiens
cacagugaccccgacguugggcug

SEQ ID NO: 44824 - RNA, 22 nt, Homo sapiens
ccuucgccacagcccuuagagu

SEQ ID NO: 44825 - RNA, 18 nt, Homo sapiens
cugagccugcccuggcuu

SEQ ID NO: 44826 - RNA, 19 nt, Homo sapiens
guaucaggaagguaccugu

SEQ ID NO: 44827 - RNA, 18 nt, Homo sapiens
ucauuagugcagaacuca

SEQ ID NO: 44828 - RNA, 20 nt, Homo sapiens
ucugccagugccuugaucuu

SEQ ID NO: 44829 - RNA, 22 nt, Homo sapiens
aagauuagguccucagcagcau

SEQ ID NO: 44830 - RNA, 22 nt, Homo sapiens
aaggcacuuggagcaaagguca

SEQ ID NO: 44831 - RNA, 16 nt, Homo sapiens
cugauaucuugcugua

SEQ ID NO: 44832 - RNA, 17 nt, Homo sapiens
cuuaaggcacuuggagc

SEQ ID NO: 44833 - RNA, 21 nt, Homo sapiens
guauuacaacaucacugcgcu

SEQ ID NO: 44834 - RNA, 20 nt, Homo sapiens
ugggggcaaguuuuagauga

SEQ ID NO: 44835 - RNA, 19 nt, Homo sapiens
ggcagggugaggggcgcca

SEQ ID NO: 44836 - RNA, 20 nt, Homo sapiens
aaagugcuguacaaauucca

SEQ ID NO: 44837 - RNA, 21 nt, Homo sapiens
cgcccagugagccagccccca

SEQ ID NO: 44838 - RNA, 21 nt, Homo sapiens
gggcggggcaacggcucccca

SEQ ID NO: 44839 - RNA, 17 nt, Homo sapiens
gguuuccugucccccca

SEQ ID NO: 44840 - RNA, 22 nt, Homo sapiens
aucugaaaacccugcuugguuc

SEQ ID NO: 44841 - RNA, 23 nt, Homo sapiens
ccuccccaagccugugucuguga

SEQ ID NO: 44842 - RNA, 23 nt, Homo sapiens
cuguggaugugagcauugcuuug

SEQ ID NO: 44843 - RNA, 20 nt, Homo sapiens
gaacuaauucuguuacguca

SEQ ID NO: 44844 - RNA, 23 nt, Homo sapiens
gaggaagugucauccucuggcuu

SEQ ID NO: 44845 - RNA, 18 nt, Homo sapiens
uaauuccuagucauuuuu

SEQ ID NO: 44846 - RNA, 18 nt, Homo sapiens
uagaugggcucuucugga

SEQ ID NO: 44847 - RNA, 21 nt, Homo sapiens
uaggugguugauuugaaacug

SEQ ID NO: 44848 - RNA, 16 nt, Homo sapiens
uccagcccugcacugc

SEQ ID NO: 44849 - RNA, 19 nt, Homo sapiens
cagccugccguuugccacu

SEQ ID NO: 44850 - RNA, 19 nt, Homo sapiens
cgccaaugccccugccucu

SEQ ID NO: 44851 - RNA, 18 nt, Homo sapiens
gaacauaucugcagagcc

SEQ ID NO: 44852 - RNA, 24 nt, Homo sapiens
gaaccaggaagacucauguguggg

SEQ ID NO: 44853 - RNA, 18 nt, Homo sapiens
aggaguuugaccagauga

SEQ ID NO: 44854 - RNA, 24 nt, Homo sapiens
cucuggccaccaagaauuugugaa

SEQ ID NO: 44855 - RNA, 20 nt, Homo sapiens
gccugaggccaccaugccac

SEQ ID NO: 44856 - RNA, 22 nt, Homo sapiens
gggaaggaggcugcuggguagc

SEQ ID NO: 44857 - RNA, 18 nt, Homo sapiens
guagcaugaguugcccaa

SEQ ID NO: 44858 - RNA, 20 nt, Homo sapiens
uugaugaccuccaauagcuc

SEQ ID NO: 44859 - RNA, 22 nt, Homo sapiens
cccagaccuaggggcuccccaa

SEQ ID NO: 44860 - RNA, 22 nt, Homo sapiens
gcccuggcccccacaggcucag

SEQ ID NO: 44861 - RNA, 22 nt, Homo sapiens
gccugcccccacugucuggccu

SEQ ID NO: 44862 - RNA, 21 nt, Homo sapiens
gugucuccaagcuucccagug

SEQ ID NO: 44863 - RNA, 18 nt, Homo sapiens
ccccuccccacucugauc

SEQ ID NO: 44864 - RNA, 21 nt, Homo sapiens
ccuuggcagaggggucuggag

SEQ ID NO: 44865 - RNA, 21 nt, Homo sapiens
gccauuucugagggcaaauca

SEQ ID NO: 44866 - RNA, 24 nt, Homo sapiens
gcgucagauggcacuggcggguuu

SEQ ID NO: 44867 - RNA, 21 nt, Homo sapiens
ggcagaagcuccacuagcuca

SEQ ID NO: 44868 - RNA, 18 nt, Homo sapiens
uuuccaggauguuugugu

SEQ ID NO: 44869 - RNA, 17 nt, Homo sapiens
ucaagugauucuccugc

SEQ ID NO: 44870 - RNA, 20 nt, Homo sapiens
uggccaggcuggucuugaac

SEQ ID NO: 44871 - RNA, 18 nt, Homo sapiens
uuccagaaagcauguccg

SEQ ID NO: 44872 - RNA, 16 nt, Homo sapiens
aguaccaugguucuga

SEQ ID NO: 44873 - RNA, 21 nt, Homo sapiens
cagaauuccacccaucuuuca

SEQ ID NO: 44874 - RNA, 25 nt, Homo sapiens
ccaucccaggucaccaccuggcuga

SEQ ID NO: 44875 - RNA, 21 nt, Homo sapiens
ccaugguucugacagagacug

SEQ ID NO: 44876 - RNA, 17 nt, Homo sapiens
ccuccaacuugacauca

SEQ ID NO: 44877 - RNA, 21 nt, Homo sapiens
cacugaaaagaauccauuuaa

SEQ ID NO: 44878 - RNA, 20 nt, Homo sapiens
ccugcaccaccguuuuugaa

SEQ ID NO: 44879 - RNA, 18 nt, Homo sapiens
aacaguagccaaaccccu

SEQ ID NO: 44880 - RNA, 20 nt, Homo sapiens
aggacugcagcaucuucauc

SEQ ID NO: 44881 - RNA, 19 nt, Homo sapiens
cuuccccagacuugcacug

SEQ ID NO: 44882 - RNA, 18 nt, Homo sapiens
gccuucagcagcagcuca

SEQ ID NO: 44883 - RNA, 18 nt, Homo sapiens
uuggagugacugucuggc

SEQ ID NO: 44884 - RNA, 24 nt, Homo sapiens
aagaugcaugagacauuguaguca

SEQ ID NO: 44885 - RNA, 24 nt, Homo sapiens
auaucgaaucccucuuucaugaga

SEQ ID NO: 44886 - RNA, 18 nt, Homo sapiens
caacuaguccuugugauu

SEQ ID NO: 44887 - RNA, 18 nt, Homo sapiens
caccagcagaucaucuuu

SEQ ID NO: 44888 - RNA, 20 nt, Homo sapiens
caggauuccuggguucuguu

SEQ ID NO: 44889 - RNA, 19 nt, Homo sapiens
cugcaaccuccgccuccca

SEQ ID NO: 44890 - RNA, 21 nt, Homo sapiens
gaucucaggugaucuacccuc

SEQ ID NO: 44891 - RNA, 23 nt, Homo sapiens
gccugagccaccgcgcccggccu

SEQ ID NO: 44892 - RNA, 20 nt, Homo sapiens
ugagucauuggcuggguucu

SEQ ID NO: 44893 - RNA, 22 nt, Homo sapiens
ccauguggaauaaaacgacgag

SEQ ID NO: 44894 - RNA, 22 nt, Homo sapiens
cguccccgccaacccugcucgc

SEQ ID NO: 44895 - RNA, 23 nt, Homo sapiens
uggcgaaccacacgacgcugcgg

SEQ ID NO: 44896 - RNA, 21 nt, Homo sapiens
agccauccugucuucugcuug

SEQ ID NO: 44897 - RNA, 23 nt, Homo sapiens
accgcggacaucacaccauucca

SEQ ID NO: 44898 - RNA, 18 nt, Homo sapiens
agacuugugaucacgccc

SEQ ID NO: 44899 - RNA, 22 nt, Homo sapiens
cggcccagguuccccgcaccuc

SEQ ID NO: 44900 - RNA, 23 nt, Homo sapiens
gcucugggcucagggaagcugcg

SEQ ID NO: 44901 - RNA, 18 nt, Homo sapiens
agaaucuaagauguagua

SEQ ID NO: 44902 - RNA, 21 nt, Homo sapiens
gccuguagucccagauacuca

SEQ ID NO: 44903 - RNA, 18 nt, Homo sapiens
ggaaucucagugcagugu

SEQ ID NO: 44904 - RNA, 17 nt, Homo sapiens
ucaagugauucuccugc

SEQ ID NO: 44905 - RNA, 20 nt, Homo sapiens
uggucaggcuggucuugaac

SEQ ID NO: 44906 - RNA, 21 nt, Homo sapiens
uuuguaaauaugcuguaguca

SEQ ID NO: 44907 - RNA, 22 nt, Homo sapiens
gagaccagcaucucggccugag

SEQ ID NO: 44908 - RNA, 18 nt, Homo sapiens
cugagcauaugccuggcu

SEQ ID NO: 44909 - RNA, 18 nt, Homo sapiens
gguccuuuguuguuuuua

SEQ ID NO: 44910 - RNA, 19 nt, Homo sapiens
ucagaucaucaccaugcca

SEQ ID NO: 44911 - RNA, 22 nt, Homo sapiens
uuucccccaguauugguuuuca

SEQ ID NO: 44912 - RNA, 17 nt, Homo sapiens
ucaagugauucuccugc

SEQ ID NO: 44913 - RNA, 19 nt, Homo sapiens
acaaggcuucagguucguc

SEQ ID NO: 44914 - RNA, 16 nt, Homo sapiens
acugacacgugccagc

SEQ ID NO: 44915 - RNA, 21 nt, Homo sapiens
agaaaggugauggccaagaua

SEQ ID NO: 44916 - RNA, 19 nt, Homo sapiens
agccaacccaaacccgcgc

SEQ ID NO: 44917 - RNA, 19 nt, Homo sapiens
caacccuuggucuacugcu

SEQ ID NO: 44918 - RNA, 19 nt, Homo sapiens
cauuagaagagaugccuuu

SEQ ID NO: 44919 - RNA, 18 nt, Homo sapiens
cugcugcauggcuggcca

SEQ ID NO: 44920 - RNA, 25 nt, Homo sapiens
gagacuaauaucagaguacccagca

SEQ ID NO: 44921 - RNA, 20 nt, Homo sapiens
gcaagaguauaggacauuga

SEQ ID NO: 44922 - RNA, 23 nt, Homo sapiens
gcccuucucguucuguaaagaaa

SEQ ID NO: 44923 - RNA, 21 nt, Homo sapiens
ggcgagcucccccgcgccgca

SEQ ID NO: 44924 - RNA, 18 nt, Homo sapiens
ucuuucucccaggccuca

SEQ ID NO: 44925 - RNA, 19 nt, Homo sapiens
agcucuuacucucuucugu

SEQ ID NO: 44926 - RNA, 19 nt, Homo sapiens
caaagagccgcacugcucc

SEQ ID NO: 44927 - RNA, 21 nt, Homo sapiens
ccuccugccugcacgccuuca

SEQ ID NO: 44928 - RNA, 16 nt, Homo sapiens
cugauggccccuggag

SEQ ID NO: 44929 - RNA, 21 nt, Homo sapiens
cuuuuuacuaacaaaauacaa

SEQ ID NO: 44930 - RNA, 19 nt, Homo sapiens
uggguggauccuacuugga

SEQ ID NO: 44931 - RNA, 17 nt, Homo sapiens
uucuuugucuuuggccu

SEQ ID NO: 44932 - RNA, 19 nt, Homo sapiens
agucauaauguucaucaua

SEQ ID NO: 44933 - RNA, 16 nt, Homo sapiens
augcagcuggaucuaa

SEQ ID NO: 44934 - RNA, 18 nt, Homo sapiens
gaguggaaguggaugcac

SEQ ID NO: 44935 - RNA, 19 nt, Homo sapiens
guggcuuuuuguuucccca

SEQ ID NO: 44936 - RNA, 21 nt, Homo sapiens
cucugggaaagauuucauuuu

SEQ ID NO: 44937 - RNA, 19 nt, Homo sapiens
gacauucaguucuguaaga

SEQ ID NO: 44938 - RNA, 19 nt, Homo sapiens
guauaagcacauuugacug

SEQ ID NO: 44939 - RNA, 19 nt, Homo sapiens
gcuccaaaaucccauuuga

SEQ ID NO: 44940 - RNA, 20 nt, Homo sapiens
aacgauguuuauauguuaag

SEQ ID NO: 44941 - RNA, 22 nt, Homo sapiens
cugacaacuggcaaagauguca

SEQ ID NO: 44942 - RNA, 18 nt, Homo sapiens
cuucauuauuguuuccuu

SEQ ID NO: 44943 - RNA, 26 nt, Homo sapiens
cuuugguccaccuggaggcccgugaa

SEQ ID NO: 44944 - RNA, 21 nt, Homo sapiens
uaaaggacauuuccuggucuu

SEQ ID NO: 44945 - RNA, 19 nt, Homo sapiens
ucgaugaauuuaaaccuca

SEQ ID NO: 44946 - RNA, 22 nt, Homo sapiens
uggauguuucuagugggagcug

SEQ ID NO: 44947 - RNA, 19 nt, Homo sapiens
uaaagaagaacugaagaua

SEQ ID NO: 44948 - RNA, 21 nt, Homo sapiens
accaggccuaggaucucccca

SEQ ID NO: 44949 - RNA, 20 nt, Homo sapiens
ccaagggccccacccagcuc

SEQ ID NO: 44950 - RNA, 21 nt, Homo sapiens
cugacucuuacauuucuuugg

SEQ ID NO: 44951 - RNA, 18 nt, Homo sapiens
gcagccgcuccucuccuc

SEQ ID NO: 44952 - RNA, 21 nt, Homo sapiens
ccuggcacacagacauaaagc

SEQ ID NO: 44953 - RNA, 17 nt, Homo sapiens
cuggcugucccuggccu

SEQ ID NO: 44954 - RNA, 18 nt, Homo sapiens
gcaccacuuccugccccc

SEQ ID NO: 44955 - RNA, 25 nt, Homo sapiens
ugggugggagauggacguuaggcug

SEQ ID NO: 44956 - RNA, 17 nt, Homo sapiens
uucaaguggcaucaaug

SEQ ID NO: 44957 - RNA, 19 nt, Homo sapiens
cugaaaugccucuucuucc

SEQ ID NO: 44958 - RNA, 23 nt, Homo sapiens
cuucuuuguuccucucugccccu

SEQ ID NO: 44959 - RNA, 18 nt, Homo sapiens
ugaggcuauauggggcug

SEQ ID NO: 44960 - RNA, 18 nt, Homo sapiens
uuuuccugccucuugaua

SEQ ID NO: 44961 - RNA, 18 nt, Homo sapiens
accagagaagugcuaggc

SEQ ID NO: 44962 - RNA, 20 nt, Homo sapiens
aguuuggcuguguccccacc

SEQ ID NO: 44963 - RNA, 19 nt, Homo sapiens
cuuuuaagguauuaucuca

SEQ ID NO: 44964 - RNA, 22 nt, Homo sapiens
ucagucauugcacaagugcuug

SEQ ID NO: 44965 - RNA, 18 nt, Homo sapiens
uuguuaucucugcuugca

SEQ ID NO: 44966 - RNA, 20 nt, Homo sapiens
acaggaccuaccucauagaa

SEQ ID NO: 44967 - RNA, 19 nt, Homo sapiens
accuuuaaauggaauccca

SEQ ID NO: 44968 - RNA, 20 nt, Homo sapiens
ccugaguaguuccuucccuu

SEQ ID NO: 44969 - RNA, 18 nt, Homo sapiens
gugcuucaccuccauuua

SEQ ID NO: 44970 - RNA, 22 nt, Homo sapiens
uauguacuauagacauguuaau

SEQ ID NO: 44971 - RNA, 23 nt, Homo sapiens
ugaaggcacucuggcauaggcug

SEQ ID NO: 44972 - RNA, 19 nt, Homo sapiens
ugggccauaacaugccuuu

SEQ ID NO: 44973 - RNA, 20 nt, Homo sapiens
uguaucagaaaugcauaccu

SEQ ID NO: 44974 - RNA, 24 nt, Homo sapiens
auggauuccguauuuugauaugaa

SEQ ID NO: 44975 - RNA, 20 nt, Homo sapiens
ucaaagaggcaaggugcccc

SEQ ID NO: 44976 - RNA, 18 nt, Homo sapiens
agccgcagccuccgccac

SEQ ID NO: 44977 - RNA, 19 nt, Homo sapiens
ccccgcccgcggccccacc

SEQ ID NO: 44978 - RNA, 24 nt, Homo sapiens
cgccacagccgccgccuccacccc

SEQ ID NO: 44979 - RNA, 19 nt, Homo sapiens
gccuccacccccggcccca

SEQ ID NO: 44980 - RNA, 23 nt, Homo sapiens
ggaacucgccgcccgcucgcucu

SEQ ID NO: 44981 - RNA, 18 nt, Homo sapiens
ugggaagcaaguuuguca

SEQ ID NO: 44982 - RNA, 19 nt, Homo sapiens
cccacauguugacaguaga

SEQ ID NO: 44983 - RNA, 20 nt, Homo sapiens
gcaaggagcaaauggccuca

SEQ ID NO: 44984 - RNA, 22 nt, Homo sapiens
uuucuuuauuccauguucuaua

SEQ ID NO: 44985 - RNA, 20 nt, Homo sapiens
aggcacuugaggccuugcuu

SEQ ID NO: 44986 - RNA, 20 nt, Homo sapiens
cuuuucucuacauacagugc

SEQ ID NO: 44987 - RNA, 21 nt, Homo sapiens
gcuucuuggagccucugggga

SEQ ID NO: 44988 - RNA, 19 nt, Homo sapiens
uagucccaucugcauuuca

SEQ ID NO: 44989 - RNA, 19 nt, Homo sapiens
aaacagaaacccugagccg

SEQ ID NO: 44990 - RNA, 20 nt, Homo sapiens
cauuuaucuucccccacccu

SEQ ID NO: 44991 - RNA, 20 nt, Homo sapiens
aguagccagcucaccaaggc

SEQ ID NO: 44992 - RNA, 24 nt, Homo sapiens
ccucaccccuuugccuugcugucu

SEQ ID NO: 44993 - RNA, 24 nt, Homo sapiens
cuguaaaugucuaggcaugugcug

SEQ ID NO: 44994 - RNA, 19 nt, Homo sapiens
gcugucugucuccacccca

SEQ ID NO: 44995 - RNA, 21 nt, Homo sapiens
ggauggcuugaccugggauug

SEQ ID NO: 44996 - RNA, 18 nt, Homo sapiens
ggcccacaugucugacca

SEQ ID NO: 44997 - RNA, 23 nt, Homo sapiens
uguaaaugucuaggcaugugcug

SEQ ID NO: 44998 - RNA, 18 nt, Homo sapiens
uucuggccucucauccca

SEQ ID NO: 44999 - RNA, 16 nt, Homo sapiens
uuguugccugcacuca

SEQ ID NO: 45000 - RNA, 21 nt, Homo sapiens
ucugguugaaccacguggcca

SEQ ID NO: 45001 - RNA, 21 nt, Homo sapiens
uguguuggcuuaauuucugga

SEQ ID NO: 45002 - RNA, 22 nt, Homo sapiens
gaccuaauuugcagacgagccc

SEQ ID NO: 45003 - RNA, 21 nt, Homo sapiens
gaguguacgcucaaaccguuu

SEQ ID NO: 45004 - RNA, 20 nt, Homo sapiens
gcuucucccaucccugccuu

SEQ ID NO: 45005 - RNA, 19 nt, Homo sapiens
ggccuuccugccucccaca

SEQ ID NO: 45006 - RNA, 22 nt, Homo sapiens
ucagggagagccaagcacauuu

SEQ ID NO: 45007 - RNA, 21 nt, Homo sapiens
acaaaaagcccaacaugcauu

SEQ ID NO: 45008 - RNA, 19 nt, Homo sapiens
cccaacaugcauugcuagu

SEQ ID NO: 45009 - RNA, 24 nt, Homo sapiens
uccgccacauuguggagcgugcuu

SEQ ID NO: 45010 - RNA, 18 nt, Homo sapiens
uggguggaucacuugagg

SEQ ID NO: 45011 - RNA, 19 nt, Homo sapiens
aaaccuuaaaauuugguga

SEQ ID NO: 45012 - RNA, 22 nt, Homo sapiens
cuuggcuccagcuggucccucc

SEQ ID NO: 45013 - RNA, 22 nt, Homo sapiens
gagccaagaccgcaccacugca

SEQ ID NO: 45014 - RNA, 21 nt, Homo sapiens
gugauaaauauccaugaaauc

SEQ ID NO: 45015 - RNA, 21 nt, Homo sapiens
uggguggaucaccugagguua

SEQ ID NO: 45016 - RNA, 20 nt, Homo sapiens
cacuuuuccuaucugucuua

SEQ ID NO: 45017 - RNA, 17 nt, Homo sapiens
cucccucucagaagcca

SEQ ID NO: 45018 - RNA, 20 nt, Homo sapiens
uagcuuucuuacagcgucuu

SEQ ID NO: 45019 - RNA, 22 nt, Homo sapiens
aggaagguaaauaaccaaaaca

SEQ ID NO: 45020 - RNA, 19 nt, Homo sapiens
cucaaaaagugcaaaagca

SEQ ID NO: 45021 - RNA, 19 nt, Homo sapiens
cuucuucauuucugugagg

SEQ ID NO: 45022 - RNA, 24 nt, Homo sapiens
ggcaaauaagccugcauugucaua

SEQ ID NO: 45023 - RNA, 19 nt, Homo sapiens
ugaaacugcugaaaucaua

SEQ ID NO: 45024 - RNA, 21 nt, Homo sapiens
uugcauuauuauagacuggga

SEQ ID NO: 45025 - RNA, 22 nt, Homo sapiens
gacagcguugugucuccccuca

SEQ ID NO: 45026 - RNA, 21 nt, Homo sapiens
agaggguggagugaggaugca

SEQ ID NO: 45027 - RNA, 20 nt, Homo sapiens
aguuguuauuguuguuuuug

SEQ ID NO: 45028 - RNA, 19 nt, Homo sapiens
cugguaauaaaacuacaca

SEQ ID NO: 45029 - RNA, 21 nt, Homo sapiens
cuuuccucuccucuuucuuca

SEQ ID NO: 45030 - RNA, 21 nt, Homo sapiens
ucuugagauaaugaaaaguga

SEQ ID NO: 45031 - RNA, 19 nt, Homo sapiens
agcucuggaggagcccucg

SEQ ID NO: 45032 - RNA, 21 nt, Homo sapiens
gucauagaggcuugauuuuua

SEQ ID NO: 45033 - RNA, 23 nt, Homo sapiens
uggauggagggagcgugugagau

SEQ ID NO: 45034 - RNA, 22 nt, Homo sapiens
agcccaugaaucagccgcgguc

SEQ ID NO: 45035 - RNA, 18 nt, Homo sapiens
aggaaauguaauaaauuc

SEQ ID NO: 45036 - RNA, 20 nt, Homo sapiens
cccauggauggcuguucucc

SEQ ID NO: 45037 - RNA, 21 nt, Homo sapiens
acuaaucucuaucccagauga

SEQ ID NO: 45038 - RNA, 24 nt, Homo sapiens
agaaagucaucauuacugcuuuga

SEQ ID NO: 45039 - RNA, 18 nt, Homo sapiens
ccugcaaccuccaccucc

SEQ ID NO: 45040 - RNA, 19 nt, Homo sapiens
accaaagaacagauccugg

SEQ ID NO: 45041 - RNA, 20 nt, Homo sapiens
aggaugugugguccugguga

SEQ ID NO: 45042 - RNA, 22 nt, Homo sapiens
agacacuggaaagagaauacua

SEQ ID NO: 45043 - RNA, 15 nt, Homo sapiens
aggagaccccuccca

SEQ ID NO: 45044 - RNA, 21 nt, Homo sapiens
aguugcacauguuuuccccua

SEQ ID NO: 45045 - RNA, 20 nt, Homo sapiens
ggccucacucuguugcacaa

SEQ ID NO: 45046 - RNA, 17 nt, Homo sapiens
ucaaaaucuccacagua

SEQ ID NO: 45047 - RNA, 17 nt, Homo sapiens
aauaguggggagugcua

SEQ ID NO: 45048 - RNA, 22 nt, Homo sapiens
ccacgcuucagacuucuucccu

SEQ ID NO: 45049 - RNA, 17 nt, Homo sapiens
cccagcucauuuugcag

SEQ ID NO: 45050 - RNA, 18 nt, Homo sapiens
cucccuagugaccaggga

SEQ ID NO: 45051 - RNA, 23 nt, Homo sapiens
cugacuucuuuggagacacaccg

SEQ ID NO: 45052 - RNA, 20 nt, Homo sapiens
ggacaacauguccuuccucu

SEQ ID NO: 45053 - RNA, 20 nt, Homo sapiens
uuuaacauauaauauagcag

SEQ ID NO: 45054 - RNA, 18 nt, Homo sapiens
aaaggagaaugugugaua

SEQ ID NO: 45055 - RNA, 23 nt, Homo sapiens
agacccccaccccccgacccccc

SEQ ID NO: 45056 - RNA, 16 nt, Homo sapiens
ccagaacuaucagaga

SEQ ID NO: 45057 - RNA, 19 nt, Homo sapiens
gaucagagcucaccuuucu

SEQ ID NO: 45058 - RNA, 17 nt, Homo sapiens
gcuagaacccagagagg

SEQ ID NO: 45059 - RNA, 18 nt, Homo sapiens
gcuccuggcauggaacug

SEQ ID NO: 45060 - RNA, 17 nt, Homo sapiens
ggcccuggguggaauug

SEQ ID NO: 45061 - RNA, 19 nt, Homo sapiens
uggaugggcuucuaucaga

SEQ ID NO: 45062 - RNA, 16 nt, Homo sapiens
ugucaaggccuugcuc

SEQ ID NO: 45063 - RNA, 21 nt, Homo sapiens
uuuuccaacccaaaagcagac

SEQ ID NO: 45064 - RNA, 19 nt, Homo sapiens
uuuuggcggcgcccucugc

SEQ ID NO: 45065 - RNA, 25 nt, Homo sapiens
aauaaccuguucauaugccaauuca

SEQ ID NO: 45066 - RNA, 19 nt, Homo sapiens
agaauggaugcuuccauca

SEQ ID NO: 45067 - RNA, 19 nt, Homo sapiens
ccauuagggaccaucugug

SEQ ID NO: 45068 - RNA, 18 nt, Homo sapiens
cacacauacauagacaca

SEQ ID NO: 45069 - RNA, 21 nt, Homo sapiens
ucgccaggugacugucccacc

SEQ ID NO: 45070 - RNA, 22 nt, Homo sapiens
cccacucuccaccccgccgcca

SEQ ID NO: 45071 - RNA, 16 nt, Homo sapiens
ggcagcggcgcuaagc

SEQ ID NO: 45072 - RNA, 21 nt, Homo sapiens
ccaaguguugugacugugcca

SEQ ID NO: 45073 - RNA, 20 nt, Homo sapiens
gggacggccccaccaccacc

SEQ ID NO: 45074 - RNA, 20 nt, Homo sapiens
aacucugucaacucgaaaua

SEQ ID NO: 45075 - RNA, 18 nt, Homo sapiens
ggccuggaaaccacgcug

SEQ ID NO: 45076 - RNA, 21 nt, Homo sapiens
cgggcggugcgcugcaggcca

SEQ ID NO: 45077 - RNA, 20 nt, Homo sapiens
gcgcagagggcuggcuggga

SEQ ID NO: 45078 - RNA, 18 nt, Homo sapiens
ggucuucgaaacccucuc

SEQ ID NO: 45079 - RNA, 26 nt, Homo sapiens
uaaauuuuacuccaaccauguguaca

SEQ ID NO: 45080 - RNA, 21 nt, Homo sapiens
ucuuucccacucaguuuugca

SEQ ID NO: 45081 - RNA, 23 nt, Homo sapiens
agcuacagaauuuugccagauga

SEQ ID NO: 45082 - RNA, 18 nt, Homo sapiens
aucauuuguuaaugaugu

SEQ ID NO: 45083 - RNA, 22 nt, Homo sapiens
caagauguccuuaggucugguu

SEQ ID NO: 45084 - RNA, 17 nt, Homo sapiens
gaacaauguguaaaaua

SEQ ID NO: 45085 - RNA, 24 nt, Homo sapiens
gggcuguuauucagaacaccgcac

SEQ ID NO: 45086 - RNA, 18 nt, Homo sapiens
ucugcugacauuccuugg

SEQ ID NO: 45087 - RNA, 19 nt, Homo sapiens
cuaguaguucuuuaacuuu

SEQ ID NO: 45088 - RNA, 19 nt, Homo sapiens
aauugaaucugcagcaucu

SEQ ID NO: 45089 - RNA, 20 nt, Homo sapiens
accugcuccacaaucuccau

SEQ ID NO: 45090 - RNA, 23 nt, Homo sapiens
caaaacacaaugacuugguuacu

SEQ ID NO: 45091 - RNA, 19 nt, Homo sapiens
cuaguaguucuuuaacuuu

SEQ ID NO: 45092 - RNA, 19 nt, Homo sapiens
cucucuggcaagaacauua

SEQ ID NO: 45093 - RNA, 22 nt, Homo sapiens
cuuuccauugaccauuaugacu

SEQ ID NO: 45094 - RNA, 19 nt, Homo sapiens
guguguauccaauguuuua

SEQ ID NO: 45095 - RNA, 23 nt, Homo sapiens
uaaaaacaaacuuuaacaaagag

SEQ ID NO: 45096 - RNA, 24 nt, Homo sapiens
uagccccucccccacauacacaca

SEQ ID NO: 45097 - RNA, 21 nt, Homo sapiens
uccuuuuuuuguaaaauaccu

SEQ ID NO: 45098 - RNA, 24 nt, Homo sapiens
uuuggguauauguacauacauuca

SEQ ID NO: 45099 - RNA, 17 nt, Homo sapiens
aggugggggggugcuca

SEQ ID NO: 45100 - RNA, 20 nt, Homo sapiens
ucccugcuccacagcuuuca

SEQ ID NO: 45101 - RNA, 21 nt, Homo sapiens
acuuaaggauccuucuaguca

SEQ ID NO: 45102 - RNA, 22 nt, Homo sapiens
ccaaaaaagauucgguugucaa

SEQ ID NO: 45103 - RNA, 17 nt, Homo sapiens
cuccccauaacaagaga

SEQ ID NO: 45104 - RNA, 22 nt, Homo sapiens
ucuuuggccucuccuuggcuuu

SEQ ID NO: 45105 - RNA, 17 nt, Homo sapiens
uugggacaugcugcuca

SEQ ID NO: 45106 - RNA, 17 nt, Homo sapiens
agaaccucugggaucuc

SEQ ID NO: 45107 - RNA, 21 nt, Homo sapiens
gaggauaagcuaacgaugcug

SEQ ID NO: 45108 - RNA, 21 nt, Homo sapiens
ggauuccacugcagcuguggc

SEQ ID NO: 45109 - RNA, 20 nt, Homo sapiens
ugaggcugcuucgccaguga

SEQ ID NO: 45110 - RNA, 19 nt, Homo sapiens
acaaacagcauuaacguca

SEQ ID NO: 45111 - RNA, 19 nt, Homo sapiens
agcauuaacgucaccuggg

SEQ ID NO: 45112 - RNA, 25 nt, Homo sapiens
agcuucuccaaagugacuaacauca

SEQ ID NO: 45113 - RNA, 20 nt, Homo sapiens
cuugagcaauuuuaaucucu

SEQ ID NO: 45114 - RNA, 20 nt, Homo sapiens
uggccaggcuggucuugaac

SEQ ID NO: 45115 - RNA, 17 nt, Homo sapiens
aaaaacaaacaaacaaa

SEQ ID NO: 45116 - RNA, 18 nt, Homo sapiens
ccaccucaaaaaaacaac

SEQ ID NO: 45117 - RNA, 20 nt, Homo sapiens
cugcuucacugcgucaucau

SEQ ID NO: 45118 - RNA, 22 nt, Homo sapiens
acuuuaggccucaacguccuca

SEQ ID NO: 45119 - RNA, 20 nt, Homo sapiens
ggcuucugcaggaggccauu

SEQ ID NO: 45120 - RNA, 20 nt, Homo sapiens
uuaagaguacauaauguucc

SEQ ID NO: 45121 - RNA, 18 nt, Homo sapiens
agccaaggacuccugaca

SEQ ID NO: 45122 - RNA, 23 nt, Homo sapiens
agcuggggcaguccagucacuca

SEQ ID NO: 45123 - RNA, 19 nt, Homo sapiens
ccauugccagccuugcugu

SEQ ID NO: 45124 - RNA, 19 nt, Homo sapiens
cgcggccgucccgauuucc

SEQ ID NO: 45125 - RNA, 18 nt, Homo sapiens
ggagagaaaaaagugacu

SEQ ID NO: 45126 - RNA, 18 nt, Homo sapiens
ucugaaggcagcugugca

SEQ ID NO: 45127 - RNA, 25 nt, Homo sapiens
ugcugucagauucaaaauugcuuuu

SEQ ID NO: 45128 - RNA, 22 nt, Homo sapiens
uugcuugugaacaaugcuuuua

SEQ ID NO: 45129 - RNA, 17 nt, Homo sapiens
acugacaccaugggcug

SEQ ID NO: 45130 - RNA, 20 nt, Homo sapiens
auggccccacagccauugca

SEQ ID NO: 45131 - RNA, 24 nt, Homo sapiens
cccagauccauccacuccacccca

SEQ ID NO: 45132 - RNA, 21 nt, Homo sapiens
ccccauuuacugucgucccca

SEQ ID NO: 45133 - RNA, 20 nt, Homo sapiens
cgcacugccacacugcucac

SEQ ID NO: 45134 - RNA, 17 nt, Homo sapiens
guccccagccucaggug

SEQ ID NO: 45135 - RNA, 18 nt, Homo sapiens
guucauuuuccccgagga

SEQ ID NO: 45136 - RNA, 17 nt, Homo sapiens
ucaagugauucuccugc

SEQ ID NO: 45137 - RNA, 18 nt, Homo sapiens
uccgccuccuggguucaa

SEQ ID NO: 45138 - RNA, 20 nt, Homo sapiens
uggccaggcuggucuugaac

SEQ ID NO: 45139 - RNA, 30 nt, Homo sapiens
cggacauuuaaucggagaaccuccugggga

SEQ ID NO: 45140 - RNA, 18 nt, Homo sapiens
ggagagagcaagccccuu

SEQ ID NO: 45141 - RNA, 20 nt, Homo sapiens
gucuuuuugauagcaaauua

SEQ ID NO: 45142 - RNA, 18 nt, Homo sapiens
ugaugacuucacugggag

SEQ ID NO: 45143 - RNA, 23 nt, Homo sapiens
auuugauuccucauuugccacau

SEQ ID NO: 45144 - RNA, 22 nt, Homo sapiens
caugcuuuuccagcucaucaca

SEQ ID NO: 45145 - RNA, 16 nt, Homo sapiens
ugauggauauuuggaa

SEQ ID NO: 45146 - RNA, 25 nt, Homo sapiens
uggaauaaccacauggcuaccuucu

SEQ ID NO: 45147 - RNA, 17 nt, Homo sapiens
cuuuuaacugcaaccac

SEQ ID NO: 45148 - RNA, 19 nt, Homo sapiens
uuauacuugccuuggcuuu

SEQ ID NO: 45149 - RNA, 17 nt, Homo sapiens
aucccaaacagcauuag

SEQ ID NO: 45150 - RNA, 22 nt, Homo sapiens
ccagacagaaagcugacagucu

SEQ ID NO: 45151 - RNA, 18 nt, Homo sapiens
ccagcugccagccugaga

SEQ ID NO: 45152 - RNA, 18 nt, Homo sapiens
ccccacggcggcccgcaa

SEQ ID NO: 45153 - RNA, 20 nt, Homo sapiens
cccgccgccccgcgucccgg

SEQ ID NO: 45154 - RNA, 19 nt, Homo sapiens
cuauuaaagagccuuucaa

SEQ ID NO: 45155 - RNA, 24 nt, Homo sapiens
cuguuucauaagagcacaauguac

SEQ ID NO: 45156 - RNA, 21 nt, Homo sapiens
aaucccuacuuugucauauca

SEQ ID NO: 45157 - RNA, 22 nt, Homo sapiens
acaacuccuucauucuuuguga

SEQ ID NO: 45158 - RNA, 23 nt, Homo sapiens
acccugaaacuacacaccauuuc

SEQ ID NO: 45159 - RNA, 19 nt, Homo sapiens
cguguuggcgggagccugu

SEQ ID NO: 45160 - RNA, 22 nt, Homo sapiens
gcaagauuuguguugguuuuga

SEQ ID NO: 45161 - RNA, 17 nt, Homo sapiens
uacuuugucauaucaga

SEQ ID NO: 45162 - RNA, 22 nt, Homo sapiens
uucugcucaggaguucugugag

SEQ ID NO: 45163 - RNA, 21 nt, Homo sapiens
aacuagugaggucucaagcgg

SEQ ID NO: 45164 - RNA, 20 nt, Homo sapiens
aguaccauacagucuugaug

SEQ ID NO: 45165 - RNA, 18 nt, Homo sapiens
cuuaucucccuucuccca

SEQ ID NO: 45166 - RNA, 26 nt, Homo sapiens
cuucauuauuuugaugacagcauuaa

SEQ ID NO: 45167 - RNA, 22 nt, Homo sapiens
gcacuuagcacugccuaccuca

SEQ ID NO: 45168 - RNA, 18 nt, Homo sapiens
guguugauuuuugcuggu

SEQ ID NO: 45169 - RNA, 19 nt, Homo sapiens
caugucauccaaccccuca

SEQ ID NO: 45170 - RNA, 18 nt, Homo sapiens
ucccaccauuuugggcug

SEQ ID NO: 45171 - RNA, 23 nt, Homo sapiens
uccugguucucugggaucugcgg

SEQ ID NO: 45172 - RNA, 17 nt, Homo sapiens
ugucauccaaccccuca

SEQ ID NO: 45173 - RNA, 26 nt, Homo sapiens
uugacacaaucagcuuuacuuauuca

SEQ ID NO: 45174 - RNA, 22 nt, Homo sapiens
aagaaacugaugaauuuucuga

SEQ ID NO: 45175 - RNA, 19 nt, Homo sapiens
aagcaauucuccugccuca

SEQ ID NO: 45176 - RNA, 20 nt, Homo sapiens
aucuacagccaagcaucaca

SEQ ID NO: 45177 - RNA, 22 nt, Homo sapiens
aucuuggcucacugcaaccucu

SEQ ID NO: 45178 - RNA, 21 nt, Homo sapiens
ccccuccccaccccuucuucc

SEQ ID NO: 45179 - RNA, 21 nt, Homo sapiens
cccuccccaccccuucuuccc

SEQ ID NO: 45180 - RNA, 20 nt, Homo sapiens
ccucugccucccagguucaa

SEQ ID NO: 45181 - RNA, 19 nt, Homo sapiens
cugcaaccucugccuccca

SEQ ID NO: 45182 - RNA, 21 nt, Homo sapiens
cuucguugcuucuuuggucuu

SEQ ID NO: 45183 - RNA, 21 nt, Homo sapiens
ccccacagccucccccaagcu

SEQ ID NO: 45184 - RNA, 17 nt, Homo sapiens
cggcccgccagcaccuc

SEQ ID NO: 45185 - RNA, 17 nt, Homo sapiens
gaggaggugguacagca

SEQ ID NO: 45186 - RNA, 17 nt, Homo sapiens
gcuccuccacugaccca

SEQ ID NO: 45187 - RNA, 24 nt, Homo sapiens
ugagguuaaaagggguucagguca

SEQ ID NO: 45188 - RNA, 17 nt, Homo sapiens
gaaccugcuaaggccau

SEQ ID NO: 45189 - RNA, 24 nt, Homo sapiens
ccuggagucaucuguuuuggucuu

SEQ ID NO: 45190 - RNA, 18 nt, Homo sapiens
acacuuuauuauauaaua

SEQ ID NO: 45191 - RNA, 17 nt, Homo sapiens
agaaagcaagaauaggu

SEQ ID NO: 45192 - RNA, 19 nt, Homo sapiens
caaggcagcucugcucagc

SEQ ID NO: 45193 - RNA, 17 nt, Homo sapiens
gucucagccugauccca

SEQ ID NO: 45194 - RNA, 23 nt, Homo sapiens
uuugggcccugucuagguuguuu

SEQ ID NO: 45195 - RNA, 17 nt, Homo sapiens
aaagucucccaacccca

SEQ ID NO: 45196 - RNA, 20 nt, Homo sapiens
ccaguccuuccugcacugcu

SEQ ID NO: 45197 - RNA, 21 nt, Homo sapiens
cugaaaagucucccaacccca

SEQ ID NO: 45198 - RNA, 20 nt, Homo sapiens
uggccaggcuggucuugaac

SEQ ID NO: 45199 - RNA, 21 nt, Homo sapiens
aagaauaccaugaauguaaga

SEQ ID NO: 45200 - RNA, 20 nt, Homo sapiens
cuugauuuuaaguuguuaua

SEQ ID NO: 45201 - RNA, 19 nt, Homo sapiens
cuuugaugauaaaacuugu

SEQ ID NO: 45202 - RNA, 17 nt, Homo sapiens
gcuauacacauaaaaca

SEQ ID NO: 45203 - RNA, 19 nt, Homo sapiens
uauaccucucaacaguuua

SEQ ID NO: 45204 - RNA, 22 nt, Homo sapiens
ugguacacucuaguguaggcua

SEQ ID NO: 45205 - RNA, 19 nt, Homo sapiens
uuuuagaaauuacaugaaa

SEQ ID NO: 45206 - RNA, 22 nt, Homo sapiens
uuuugagaaaaaaaguacggca

SEQ ID NO: 45207 - RNA, 18 nt, Homo sapiens
cgcuuuggggcagauuuu

SEQ ID NO: 45208 - RNA, 22 nt, Homo sapiens
cugaccagcccaggaggaacca

SEQ ID NO: 45209 - RNA, 18 nt, Homo sapiens
uacuaaaucagauuugcc

SEQ ID NO: 45210 - RNA, 20 nt, Homo sapiens
ugaaauaaaauaugcuuuaa

SEQ ID NO: 45211 - RNA, 19 nt, Homo sapiens
accaagaccaaagccagcu

SEQ ID NO: 45212 - RNA, 21 nt, Homo sapiens
aggaaaagccauuucaagaca

SEQ ID NO: 45213 - RNA, 17 nt, Homo sapiens
augcaaccaacagucaa

SEQ ID NO: 45214 - RNA, 18 nt, Homo sapiens
auuucacccacacugcca

SEQ ID NO: 45215 - RNA, 20 nt, Homo sapiens
uuucaggacuucaucaucac

SEQ ID NO: 45216 - RNA, 18 nt, Homo sapiens
aauaccaccaauaaauca

SEQ ID NO: 45217 - RNA, 19 nt, Homo sapiens
accaauaaaucaucaaaca

SEQ ID NO: 45218 - RNA, 18 nt, Homo sapiens
auguauccugcaauacug

SEQ ID NO: 45219 - RNA, 18 nt, Homo sapiens
cacgaacacacuuuuuac

SEQ ID NO: 45220 - RNA, 19 nt, Homo sapiens
caggcuuuugcuugcuauc

SEQ ID NO: 45221 - RNA, 19 nt, Homo sapiens
ccuuaaaucaauuuauuga

SEQ ID NO: 45222 - RNA, 24 nt, Homo sapiens
ccuuuuguauacuucuuuaauuuu

SEQ ID NO: 45223 - RNA, 23 nt, Homo sapiens
cuuaguuuucuugagugauuuuu

SEQ ID NO: 45224 - RNA, 17 nt, Homo sapiens
gaacuccuagaaauuuc

SEQ ID NO: 45225 - RNA, 18 nt, Homo sapiens
uaaaucacuugucaugau

SEQ ID NO: 45226 - RNA, 19 nt, Homo sapiens
uagaaauuucaagagcaua

SEQ ID NO: 45227 - RNA, 20 nt, Homo sapiens
ucaccauguauccugcaaua

SEQ ID NO: 45228 - RNA, 17 nt, Homo sapiens
ucuagcucacugccuuu

SEQ ID NO: 45229 - RNA, 18 nt, Homo sapiens
ucuuuaaugacucuuccu

SEQ ID NO: 45230 - RNA, 17 nt, Homo sapiens
ugucauuauuugcuggu

SEQ ID NO: 45231 - RNA, 17 nt, Homo sapiens
uuauuuugugucauuga

SEQ ID NO: 45232 - RNA, 21 nt, Homo sapiens
aaacaaccaacccuucauggc

SEQ ID NO: 45233 - RNA, 16 nt, Homo sapiens
aagacugcaccuguua

SEQ ID NO: 45234 - RNA, 24 nt, Homo sapiens
caacccuucauggcucuccuucag

SEQ ID NO: 45235 - RNA, 21 nt, Homo sapiens
ccaaacaggaucuggaaaacc

SEQ ID NO: 45236 - RNA, 21 nt, Homo sapiens
cccucacagaguuuuccacca

SEQ ID NO: 45237 - RNA, 18 nt, Homo sapiens
ugcaaaacagccuccuuc

SEQ ID NO: 45238 - RNA, 18 nt, Homo sapiens
aacccugacuuacgucuc

SEQ ID NO: 45239 - RNA, 18 nt, Homo sapiens
cacaugacagguuuucua

SEQ ID NO: 45240 - RNA, 16 nt, Homo sapiens
gagcuuucaaauccca

SEQ ID NO: 45241 - RNA, 23 nt, Homo sapiens
acagagacgaagagaccccaaca

SEQ ID NO: 45242 - RNA, 17 nt, Homo sapiens
agaagaaccuggaccau

SEQ ID NO: 45243 - RNA, 24 nt, Homo sapiens
cagaaaaaaacauaauucugguga

SEQ ID NO: 45244 - RNA, 20 nt, Homo sapiens
cuggaccauucuugauggag

SEQ ID NO: 45245 - RNA, 18 nt, Homo sapiens
cuuuucauccuaaaucuu

SEQ ID NO: 45246 - RNA, 20 nt, Homo sapiens
ucuguauuauuacaugugcu

SEQ ID NO: 45247 - RNA, 24 nt, Homo sapiens
agaagaaaacucaguaggcaccuu

SEQ ID NO: 45248 - RNA, 19 nt, Homo sapiens
caagaucagccuggccuag

SEQ ID NO: 45249 - RNA, 19 nt, Homo sapiens
ucucuucaugguuaugucu

SEQ ID NO: 45250 - RNA, 21 nt, Homo sapiens
ugaguggcaaagcgugggcug

SEQ ID NO: 45251 - RNA, 20 nt, Homo sapiens
uuccagaaaugaggguggca

SEQ ID NO: 45252 - RNA, 21 nt, Homo sapiens
ccauccugcaccccagucccc

SEQ ID NO: 45253 - RNA, 23 nt, Homo sapiens
cgucugugggcaccagcacuuca

SEQ ID NO: 45254 - RNA, 21 nt, Homo sapiens
cucucaccccuucgucugugg

SEQ ID NO: 45255 - RNA, 19 nt, Homo sapiens
gcccuaaauaccccagcug

SEQ ID NO: 45256 - RNA, 18 nt, Homo sapiens
uacagaaaccucaucccu

SEQ ID NO: 45257 - RNA, 22 nt, Homo sapiens
uacugccuguuucuuacuuuga

SEQ ID NO: 45258 - RNA, 22 nt, Homo sapiens
ucggugguucugccccuacucc

SEQ ID NO: 45259 - RNA, 17 nt, Homo sapiens
gacugcaacaucuuuca

SEQ ID NO: 45260 - RNA, 21 nt, Homo sapiens
caggaguuaacuucucaguga

SEQ ID NO: 45261 - RNA, 24 nt, Homo sapiens
cccauauauucaccaguuacccca

SEQ ID NO: 45262 - RNA, 26 nt, Homo sapiens
gauaauuccgaaacgccugcacauga

SEQ ID NO: 45263 - RNA, 19 nt, Homo sapiens
caggccucaggcccccuca

SEQ ID NO: 45264 - RNA, 19 nt, Homo sapiens
ccaaaaauccacauucucc

SEQ ID NO: 45265 - RNA, 21 nt, Homo sapiens
gguggguggagggggaugcug

SEQ ID NO: 45266 - RNA, 20 nt, Homo sapiens
ugaauggccucuucugccag

SEQ ID NO: 45267 - RNA, 20 nt, Homo sapiens
ggccuccacaccacgaaaga

SEQ ID NO: 45268 - RNA, 21 nt, Homo sapiens
ccugccuccuauggccucuca

SEQ ID NO: 45269 - RNA, 16 nt, Homo sapiens
cuggagugcuuggcuu

SEQ ID NO: 45270 - RNA, 20 nt, Homo sapiens
gguauagaauuuuuguuuag

SEQ ID NO: 45271 - RNA, 22 nt, Homo sapiens
ucucuuucaucugcuugacuuu

SEQ ID NO: 45272 - RNA, 20 nt, Homo sapiens
gcaccgcgcggggaacccgg

SEQ ID NO: 45273 - RNA, 17 nt, Homo sapiens
agaagaaccuggaccau

SEQ ID NO: 45274 - RNA, 24 nt, Homo sapiens
cagaaaaauacauaauucugguga

SEQ ID NO: 45275 - RNA, 20 nt, Homo sapiens
cuggaccauucuugauggag

SEQ ID NO: 45276 - RNA, 18 nt, Homo sapiens
cuuuucauccuaaaucuu

SEQ ID NO: 45277 - RNA, 20 nt, Homo sapiens
ucuguauuauuauaugugcu

SEQ ID NO: 45278 - RNA, 17 nt, Homo sapiens
aggacuuggugauuacc

SEQ ID NO: 45279 - RNA, 19 nt, Homo sapiens
aguuguacaacaccagcaa

SEQ ID NO: 45280 - RNA, 17 nt, Homo sapiens
augaaguuguacaacac

SEQ ID NO: 45281 - RNA, 22 nt, Homo sapiens
ccuucucaagaccgaguguaca

SEQ ID NO: 45282 - RNA, 20 nt, Homo sapiens
cugccauuuuuugucuguga

SEQ ID NO: 45283 - RNA, 19 nt, Homo sapiens
uuacaguggcaguauugac

SEQ ID NO: 45284 - RNA, 22 nt, Homo sapiens
uucuacaauacaacacauugaa

SEQ ID NO: 45285 - RNA, 18 nt, Homo sapiens
uucuucguggauuguuuu

SEQ ID NO: 45286 - RNA, 18 nt, Homo sapiens
uccuaagccaaaagaaca

SEQ ID NO: 45287 - RNA, 17 nt, Homo sapiens
aaacacugaacaaccuc

SEQ ID NO: 45288 - RNA, 18 nt, Homo sapiens
acugcugauauuuccacc

SEQ ID NO: 45289 - RNA, 22 nt, Homo sapiens
acagagugcagagaccccggca

SEQ ID NO: 45290 - RNA, 20 nt, Homo sapiens
cagagcacguguuucgcggc

SEQ ID NO: 45291 - RNA, 22 nt, Homo sapiens
ccugggucaaccgcccugcagc

SEQ ID NO: 45292 - RNA, 22 nt, Homo sapiens
cgagaccugcgcgcgcuccgcg

SEQ ID NO: 45293 - RNA, 22 nt, Homo sapiens
cgaggccuggucagccugcagu

SEQ ID NO: 45294 - RNA, 19 nt, Homo sapiens
cgcugcauuuguaccgcug

SEQ ID NO: 45295 - RNA, 19 nt, Homo sapiens
gcggcugcucacagagcac

SEQ ID NO: 45296 - RNA, 18 nt, Homo sapiens
ucugcccuguggcugcuu

SEQ ID NO: 45297 - RNA, 20 nt, Homo sapiens
aaucauagcagcagcagcca

SEQ ID NO: 45298 - RNA, 18 nt, Homo sapiens
cagcagcagccagcacca

SEQ ID NO: 45299 - RNA, 18 nt, Homo sapiens
cacuuucacaauuagcau

SEQ ID NO: 45300 - RNA, 19 nt, Homo sapiens
ggaggaggaggggaucgcc

SEQ ID NO: 45301 - RNA, 18 nt, Homo sapiens
agcugcccauuuccuaca

SEQ ID NO: 45302 - RNA, 20 nt, Homo sapiens
ugcaaggaagaaauacuuca

SEQ ID NO: 45303 - RNA, 18 nt, Homo sapiens
cuuggacauccugaacau

SEQ ID NO: 45304 - RNA, 17 nt, Homo sapiens
agaagguuuuggauaaa

SEQ ID NO: 45305 - RNA, 18 nt, Homo sapiens
ugaaugugcugccaguga

SEQ ID NO: 45306 - RNA, 19 nt, Homo sapiens
caauggagauauugaugaa

SEQ ID NO: 45307 - RNA, 19 nt, Homo sapiens
uuccaugaaaaugcuccag

SEQ ID NO: 45308 - RNA, 22 nt, Homo sapiens
aagcacuuaaacgacuucauca

SEQ ID NO: 45309 - RNA, 19 nt, Homo sapiens
cuggucaaacugggucugc

SEQ ID NO: 45310 - RNA, 22 nt, Homo sapiens
agaagagaaaggcaaguaccuu

SEQ ID NO: 45311 - RNA, 19 nt, Homo sapiens
guaccaugauaccccugga

SEQ ID NO: 45312 - RNA, 22 nt, Homo sapiens
agcuccuucuuuugccauccca

SEQ ID NO: 45313 - RNA, 20 nt, Homo sapiens
aucuccaggcccaaaacuuc

SEQ ID NO: 45314 - RNA, 26 nt, Homo sapiens
gccucacuguggaccacccaagccaa

SEQ ID NO: 45315 - RNA, 18 nt, Homo sapiens
aucucccuaaggaagagu

SEQ ID NO: 45316 - RNA, 20 nt, Homo sapiens
caacccucuggaucaccucu

SEQ ID NO: 45317 - RNA, 22 nt, Homo sapiens
ucaaucucagggauaauaccca

SEQ ID NO: 45318 - RNA, 18 nt, Homo sapiens
uuccuuuuaguauucaug

SEQ ID NO: 45319 - RNA, 19 nt, Homo sapiens
uucucuacugaaaauacaa

SEQ ID NO: 45320 - RNA, 22 nt, Homo sapiens
uuguaaauaugucuguaauauu

SEQ ID NO: 45321 - RNA, 22 nt, Homo sapiens
gaccucaucacuggauuugcca

SEQ ID NO: 45322 - RNA, 19 nt, Homo sapiens
acacucgcugcuuaagcuc

SEQ ID NO: 45323 - RNA, 21 nt, Homo sapiens
gccaccccagagcccuggggg

SEQ ID NO: 45324 - RNA, 21 nt, Homo sapiens
ugcggccuccuuguuugcagg

SEQ ID NO: 45325 - RNA, 23 nt, Homo sapiens
ccauuaccaauagauuacugaug

SEQ ID NO: 45326 - RNA, 18 nt, Homo sapiens
cuuucaguuuuccauagc

SEQ ID NO: 45327 - RNA, 21 nt, Homo sapiens
gcguggugcagcucugcugcu

SEQ ID NO: 45328 - RNA, 22 nt, Homo sapiens
gcucuuuuggaggccacaggga

SEQ ID NO: 45329 - RNA, 17 nt, Homo sapiens
aggcaagaauggaacgg

SEQ ID NO: 45330 - RNA, 21 nt, Homo sapiens
gccugcaguaugcagagcccc

SEQ ID NO: 45331 - RNA, 21 nt, Homo sapiens
ggagaaacgauuucuguugac

SEQ ID NO: 45332 - RNA, 19 nt, Homo sapiens
caaugaaacaagacaauga

SEQ ID NO: 45333 - RNA, 21 nt, Homo sapiens
uugaaccuuuccuuccugcuu

SEQ ID NO: 45334 - RNA, 20 nt, Homo sapiens
ccagucugaaaaccagaccg

SEQ ID NO: 45335 - RNA, 23 nt, Homo sapiens
gccuggggcugcugaugagcuuu

SEQ ID NO: 45336 - RNA, 18 nt, Homo sapiens
gcgucccggggguuccga

SEQ ID NO: 45337 - RNA, 19 nt, Homo sapiens
accaggagaaccuagcuca

SEQ ID NO: 45338 - RNA, 22 nt, Homo sapiens
gcuggaaauccuggauuuuuuu

SEQ ID NO: 45339 - RNA, 15 nt, Homo sapiens
gugccagaugcaaua

SEQ ID NO: 45340 - RNA, 23 nt, Homo sapiens
gguuguauuuugaauguaaccaa

SEQ ID NO: 45341 - RNA, 21 nt, Homo sapiens
uucaauugaugaagaugugau

SEQ ID NO: 45342 - RNA, 18 nt, Homo sapiens
uucccuucuguuucuuac

SEQ ID NO: 45343 - RNA, 20 nt, Homo sapiens
uuccuuuuggucuucaugga

SEQ ID NO: 45344 - RNA, 18 nt, Homo sapiens
cuccgggcagggcuggga

SEQ ID NO: 45345 - RNA, 21 nt, Homo sapiens
cagggugcgcuggucccgguc

SEQ ID NO: 45346 - RNA, 16 nt, Homo sapiens
ugggcaggccacuuuu

SEQ ID NO: 45347 - RNA, 22 nt, Homo sapiens
gagccaagauugugccacugca

SEQ ID NO: 45348 - RNA, 16 nt, Homo sapiens
gagucagcugagcauc

SEQ ID NO: 45349 - RNA, 16 nt, Homo sapiens
ggauggagaacccucc

SEQ ID NO: 45350 - RNA, 20 nt, Homo sapiens
aacagaggugagcaccuuuc

SEQ ID NO: 45351 - RNA, 17 nt, Homo sapiens
aaccuugcaugucauca

SEQ ID NO: 45352 - RNA, 23 nt, Homo sapiens
ucaccaucaagcaauccauguca

SEQ ID NO: 45353 - RNA, 20 nt, Homo sapiens
ccauauuuuauguugcuuua

SEQ ID NO: 45354 - RNA, 24 nt, Homo sapiens
ccuccaggcugaaggacuguugua

SEQ ID NO: 45355 - RNA, 22 nt, Homo sapiens
gacgggguuucggcauguuggc

SEQ ID NO: 45356 - RNA, 18 nt, Homo sapiens
gccugaaauccaauaguc

SEQ ID NO: 45357 - RNA, 20 nt, Homo sapiens
ucucugccucccagguucaa

SEQ ID NO: 45358 - RNA, 21 nt, Homo sapiens
cacuaauaacauugcugucaa

SEQ ID NO: 45359 - RNA, 18 nt, Homo sapiens
gaauaauugaagucccuu

SEQ ID NO: 45360 - RNA, 21 nt, Homo sapiens
uccagcuaagagggcccaucu

SEQ ID NO: 45361 - RNA, 16 nt, Homo sapiens
ucucaccucuuuccua

SEQ ID NO: 45362 - RNA, 25 nt, Homo sapiens
uguaauugagaaaauguucaccaaa

SEQ ID NO: 45363 - RNA, 19 nt, Homo sapiens
cuacugccccccccccucu

SEQ ID NO: 45364 - RNA, 18 nt, Homo sapiens
cuccuccaaaaccaggga

SEQ ID NO: 45365 - RNA, 21 nt, Homo sapiens
uagggucccugguuccaguua

SEQ ID NO: 45366 - RNA, 22 nt, Homo sapiens
aucuccaacccuucugauaaca

SEQ ID NO: 45367 - RNA, 22 nt, Homo sapiens
gcccuuuauccgacgguucugg

SEQ ID NO: 45368 - RNA, 19 nt, Homo sapiens
aaggaaccaagcugacaca

SEQ ID NO: 45369 - RNA, 19 nt, Homo sapiens
caccauuucggacaccccg

SEQ ID NO: 45370 - RNA, 24 nt, Homo sapiens
cccguuaauaaaaaccaauguagg

SEQ ID NO: 45371 - RNA, 22 nt, Homo sapiens
gcggcugcgagggacuuuguca

SEQ ID NO: 45372 - RNA, 19 nt, Homo sapiens
agacccacuaauuugcaca

SEQ ID NO: 45373 - RNA, 18 nt, Homo sapiens
gagccacucacuuuuauu

SEQ ID NO: 45374 - RNA, 18 nt, Homo sapiens
ggagcuuuuuaaaucuca

SEQ ID NO: 45375 - RNA, 18 nt, Homo sapiens
ugagcucuucauuagcuc

SEQ ID NO: 45376 - RNA, 19 nt, Homo sapiens
acgaaccauucgcauaugg

SEQ ID NO: 45377 - RNA, 26 nt, Homo sapiens
ggaacugcuagaacgaaccauucgca

SEQ ID NO: 45378 - RNA, 19 nt, Homo sapiens
cugccaguugcauucuucc

SEQ ID NO: 45379 - RNA, 25 nt, Homo sapiens
caaggccgaagggugacaaaauaca

SEQ ID NO: 45380 - RNA, 20 nt, Homo sapiens
cugcggggucugccuggccu

SEQ ID NO: 45381 - RNA, 17 nt, Homo sapiens
cugcugauccugacgga

SEQ ID NO: 45382 - RNA, 21 nt, Homo sapiens
gacggcguccugcgcucccca

SEQ ID NO: 45383 - RNA, 20 nt, Homo sapiens
ggccaagugcgugcuggccg

SEQ ID NO: 45384 - RNA, 18 nt, Homo sapiens
ccgccuggccuucgggga

SEQ ID NO: 45385 - RNA, 20 nt, Homo sapiens
aggcggaaacagcacuucau

SEQ ID NO: 45386 - RNA, 22 nt, Homo sapiens
ccagccccugcucagccccucc

SEQ ID NO: 45387 - RNA, 20 nt, Homo sapiens
gcugccaccucgcccagcca

SEQ ID NO: 45388 - RNA, 19 nt, Homo sapiens
uucuucaucguugagcuuu

SEQ ID NO: 45389 - RNA, 21 nt, Homo sapiens
agggaaauaaaggcagaaggc

SEQ ID NO: 45390 - RNA, 20 nt, Homo sapiens
ucugaagacaauggacccac

SEQ ID NO: 45391 - RNA, 19 nt, Homo sapiens
agcccaccagauguagcac

SEQ ID NO: 45392 - RNA, 19 nt, Homo sapiens
ccaggccaucucuguuccu

SEQ ID NO: 45393 - RNA, 19 nt, Homo sapiens
ccaggucacuguugcccca

SEQ ID NO: 45394 - RNA, 20 nt, Homo sapiens
gucugguugcagaaccugca

SEQ ID NO: 45395 - RNA, 20 nt, Homo sapiens
ccacgccgaccccuccccuc

SEQ ID NO: 45396 - RNA, 21 nt, Homo sapiens
cccgcuuuuacccuccccacc

SEQ ID NO: 45397 - RNA, 19 nt, Homo sapiens
ugucuaucucaacucuauu

SEQ ID NO: 45398 - RNA, 17 nt, Homo sapiens
ucaaaaauuaagcaugu

SEQ ID NO: 45399 - RNA, 18 nt, Homo sapiens
ugaacaaugcuuaacaua

SEQ ID NO: 45400 - RNA, 16 nt, Homo sapiens
caugagggugugguca

SEQ ID NO: 45401 - RNA, 22 nt, Homo sapiens
ccaauuaaaaggugacccaaca

SEQ ID NO: 45402 - RNA, 23 nt, Homo sapiens
cccggcuguggcgcuucugugga

SEQ ID NO: 45403 - RNA, 18 nt, Homo sapiens
cuuccagaagcaacccag

SEQ ID NO: 45404 - RNA, 17 nt, Homo sapiens
ucauugaauucugguga

SEQ ID NO: 45405 - RNA, 20 nt, Homo sapiens
aaacagugauugaguuuguu

SEQ ID NO: 45406 - RNA, 19 nt, Homo sapiens
ucaguggggcacugaagaa

SEQ ID NO: 45407 - RNA, 18 nt, Homo sapiens
aagacccuaaaacugccc

SEQ ID NO: 45408 - RNA, 19 nt, Homo sapiens
ugaacgaccuggugucuga

SEQ ID NO: 45409 - RNA, 20 nt, Homo sapiens
auucuacccaccucuaugca

SEQ ID NO: 45410 - RNA, 20 nt, Homo sapiens
ccaccgccaccggcugagcu

SEQ ID NO: 45411 - RNA, 19 nt, Homo sapiens
cgcauccuggaaaaaagga

SEQ ID NO: 45412 - RNA, 21 nt, Homo sapiens
gccugagccccggccuggcuc

SEQ ID NO: 45413 - RNA, 22 nt, Homo sapiens
ucacccaaccucucccaccucc

SEQ ID NO: 45414 - RNA, 18 nt, Homo sapiens
ugaugacaagguguacua

SEQ ID NO: 45415 - RNA, 20 nt, Homo sapiens
uggcaccugaugugagacug

SEQ ID NO: 45416 - RNA, 23 nt, Homo sapiens
uucugacugagcucccccauucc

SEQ ID NO: 45417 - RNA, 24 nt, Homo sapiens
ccacauucccagaaacuuccagca

SEQ ID NO: 45418 - RNA, 24 nt, Homo sapiens
ugaauggauuuuaacaaauggacu

SEQ ID NO: 45419 - RNA, 17 nt, Homo sapiens
augaacaaaaccaguua

SEQ ID NO: 45420 - RNA, 27 nt, Homo sapiens
auggaaagaaaaucccagcaggagcug

SEQ ID NO: 45421 - RNA, 20 nt, Homo sapiens
gccucuguuaaggaggaguc

SEQ ID NO: 45422 - RNA, 23 nt, Homo sapiens
ucggcaagcuggagccucuguua

SEQ ID NO: 45423 - RNA, 26 nt, Homo sapiens
aaggaugugauauuaaaguuaugaua

SEQ ID NO: 45424 - RNA, 21 nt, Homo sapiens
auaucuugcaaggaugugaua

SEQ ID NO: 45425 - RNA, 19 nt, Homo sapiens
aucuugcaaggaugugaua

SEQ ID NO: 45426 - RNA, 22 nt, Homo sapiens
cuuaagugacuuaaguuauuuu

SEQ ID NO: 45427 - RNA, 19 nt, Homo sapiens
ucuaaauucauugguuuaa

SEQ ID NO: 45428 - RNA, 21 nt, Homo sapiens
gcagcaauaggguuuucauca

SEQ ID NO: 45429 - RNA, 18 nt, Homo sapiens
caacccugauccuguccu

SEQ ID NO: 45430 - RNA, 17 nt, Homo sapiens
guucuggaacccaguga

SEQ ID NO: 45431 - RNA, 19 nt, Homo sapiens
ucuacuccccggaccucaa

SEQ ID NO: 45432 - RNA, 18 nt, Homo sapiens
acugggcaccaucagcua

SEQ ID NO: 45433 - RNA, 20 nt, Homo sapiens
caacuuccaggacggagcuu

SEQ ID NO: 45434 - RNA, 18 nt, Homo sapiens
agaugggacacaaccuca

SEQ ID NO: 45435 - RNA, 20 nt, Homo sapiens
caccaucagagacagccaca

SEQ ID NO: 45436 - RNA, 22 nt, Homo sapiens
gagccaagaccccacaaugcua

SEQ ID NO: 45437 - RNA, 19 nt, Homo sapiens
ggccuggcagacgauuaua

SEQ ID NO: 45438 - RNA, 22 nt, Homo sapiens
aaaaucuccuuucugcuuccca

SEQ ID NO: 45439 - RNA, 21 nt, Homo sapiens
gcuacagaguuccuucucacc

SEQ ID NO: 45440 - RNA, 20 nt, Homo sapiens
uuccagacagaacccggcac

SEQ ID NO: 45441 - RNA, 23 nt, Homo sapiens
ccuccccgcuaaggcuggcgugc

SEQ ID NO: 45442 - RNA, 17 nt, Homo sapiens
gugcugagucugugaau

SEQ ID NO: 45443 - RNA, 24 nt, Homo sapiens
uguccugacuguccuacaauauca

SEQ ID NO: 45444 - RNA, 19 nt, Homo sapiens
aaacuccuggccucaggug

SEQ ID NO: 45445 - RNA, 22 nt, Homo sapiens
ucaccugcggccacgaccggca

SEQ ID NO: 45446 - RNA, 21 nt, Homo sapiens
acgaagauccugagacgcuua

SEQ ID NO: 45447 - RNA, 21 nt, Homo sapiens
agaaacaacaccacagaaccc

SEQ ID NO: 45448 - RNA, 20 nt, Homo sapiens
ccucugccucccggguucaa

SEQ ID NO: 45449 - RNA, 20 nt, Homo sapiens
cuguuuuuuguuuuguuuug

SEQ ID NO: 45450 - RNA, 25 nt, Homo sapiens
gucuggacccuggcuuaucugguuc

SEQ ID NO: 45451 - RNA, 22 nt, Homo sapiens
ucugccuggcaaccugaucucg

SEQ ID NO: 45452 - RNA, 21 nt, Homo sapiens
acaccucaacccuccuaguca

SEQ ID NO: 45453 - RNA, 22 nt, Homo sapiens
caagcacaaaucugggucccca

SEQ ID NO: 45454 - RNA, 18 nt, Homo sapiens
gccucccagcgccucugc

SEQ ID NO: 45455 - RNA, 22 nt, Homo sapiens
gccuccccacccaccuccugcu

SEQ ID NO: 45456 - RNA, 18 nt, Homo sapiens
ggaagagaaacuaaccac

SEQ ID NO: 45457 - RNA, 18 nt, Homo sapiens
caugugcgcauuuaugag

SEQ ID NO: 45458 - RNA, 20 nt, Homo sapiens
uccagcccccuccaucuccc

SEQ ID NO: 45459 - RNA, 17 nt, Homo sapiens
ccugauauguugcuaua

SEQ ID NO: 45460 - RNA, 19 nt, Homo sapiens
cuaauggugacugcuuggc

SEQ ID NO: 45461 - RNA, 18 nt, Homo sapiens
gcccagaagagaccucag

SEQ ID NO: 45462 - RNA, 17 nt, Homo sapiens
aauccuagggccaccuc

SEQ ID NO: 45463 - RNA, 22 nt, Homo sapiens
acgccccccaguguccuugaca

SEQ ID NO: 45464 - RNA, 24 nt, Homo sapiens
ccucagacucaaacggccaucuca

SEQ ID NO: 45465 - RNA, 18 nt, Homo sapiens
gugaugacaaacugacca

SEQ ID NO: 45466 - RNA, 17 nt, Homo sapiens
uucgccgguuucaugaa

SEQ ID NO: 45467 - RNA, 16 nt, Homo sapiens
gagccauccgugcugc

SEQ ID NO: 45468 - RNA, 17 nt, Homo sapiens
gcagccauccgugcugc

SEQ ID NO: 45469 - RNA, 20 nt, Homo sapiens
aaagucaggaggauugacag

SEQ ID NO: 45470 - RNA, 21 nt, Homo sapiens
cacuugugcccccagcucagc

SEQ ID NO: 45471 - RNA, 17 nt, Homo sapiens
cccacggcccccgcagc

SEQ ID NO: 45472 - RNA, 21 nt, Homo sapiens
ccuccuuggcgccugucccca

SEQ ID NO: 45473 - RNA, 18 nt, Homo sapiens
ccuggugacggggcuggc

SEQ ID NO: 45474 - RNA, 20 nt, Homo sapiens
gccccucagcacccugccuu

SEQ ID NO: 45475 - RNA, 16 nt, Homo sapiens
gcgccuagggcugcgg

SEQ ID NO: 45476 - RNA, 20 nt, Homo sapiens
uccuggaaggaagaucuugg

SEQ ID NO: 45477 - RNA, 23 nt, Homo sapiens
uggguggggggcagugggggcug

SEQ ID NO: 45478 - RNA, 23 nt, Homo sapiens
uuuuuuuaccccuccuuagcuuu

SEQ ID NO: 45479 - RNA, 21 nt, Homo sapiens
ccagggcgagugacaggcgag

SEQ ID NO: 45480 - RNA, 19 nt, Homo sapiens
ugcuaccuuuuuacccaca

SEQ ID NO: 45481 - RNA, 18 nt, Homo sapiens
gccucuggcugcugguuu

SEQ ID NO: 45482 - RNA, 19 nt, Homo sapiens
cugugaugaaaaucaugug

SEQ ID NO: 45483 - RNA, 23 nt, Homo sapiens
guguagggcuaauggugaauuuu

SEQ ID NO: 45484 - RNA, 21 nt, Homo sapiens
uauugaguaaguucugaaaca

SEQ ID NO: 45485 - RNA, 19 nt, Homo sapiens
cuaaaauccacaucacccu

SEQ ID NO: 45486 - RNA, 20 nt, Homo sapiens
cuagcucggcggucacccca

SEQ ID NO: 45487 - RNA, 18 nt, Homo sapiens
ucaaggauaggaaguguu

SEQ ID NO: 45488 - RNA, 18 nt, Homo sapiens
cuucccauccgcucucca

SEQ ID NO: 45489 - RNA, 19 nt, Homo sapiens
ugcccagaugggcucucca

SEQ ID NO: 45490 - RNA, 21 nt, Homo sapiens
auagauguacauauugugucg

SEQ ID NO: 45491 - RNA, 21 nt, Homo sapiens
aucauuauuuauugaugugau

SEQ ID NO: 45492 - RNA, 21 nt, Homo sapiens
cuuugcaccagaaacauauca

SEQ ID NO: 45493 - RNA, 25 nt, Homo sapiens
ggcacuuugcaccagaaacauauca

SEQ ID NO: 45494 - RNA, 20 nt, Homo sapiens
uugaaccuaaccugcauccc

SEQ ID NO: 45495 - RNA, 19 nt, Homo sapiens
ugucagcaagcagaucuga

SEQ ID NO: 45496 - RNA, 17 nt, Homo sapiens
aaguggauccucuugga

SEQ ID NO: 45497 - RNA, 20 nt, Homo sapiens
uguuguacucagugcauuua

SEQ ID NO: 45498 - RNA, 24 nt, Homo sapiens
uaacaucuuuaauagcacagcaaa

SEQ ID NO: 45499 - RNA, 19 nt, Homo sapiens
uuucaugguauagucuuuc

SEQ ID NO: 45500 - RNA, 22 nt, Homo sapiens
uagaugcacagcaguggaauug

SEQ ID NO: 45501 - RNA, 24 nt, Homo sapiens
uguuaccuuccaaggacaauguca

SEQ ID NO: 45502 - RNA, 25 nt, Homo sapiens
uaggugguugaagauauugaaauug

SEQ ID NO: 45503 - RNA, 21 nt, Homo sapiens
cagaaaagccaagacuuuaac

SEQ ID NO: 45504 - RNA, 23 nt, Homo sapiens
gucugagguugcuggcuaacuuu

SEQ ID NO: 45505 - RNA, 22 nt, Homo sapiens
uauuucagaguaaaaucuccua

SEQ ID NO: 45506 - RNA, 23 nt, Homo sapiens
gccuggguuuccugcccuggccc

SEQ ID NO: 45507 - RNA, 19 nt, Homo sapiens
aaacaagaaaaugauguua

SEQ ID NO: 45508 - RNA, 22 nt, Homo sapiens
acagagaacuggaaucucacuu

SEQ ID NO: 45509 - RNA, 18 nt, Homo sapiens
agaaaaaucacugugcug

SEQ ID NO: 45510 - RNA, 18 nt, Homo sapiens
cccagagauucuacccag

SEQ ID NO: 45511 - RNA, 17 nt, Homo sapiens
cgcaaaagauguaccug

SEQ ID NO: 45512 - RNA, 21 nt, Homo sapiens
cuuuaugguucaauaaauaua

SEQ ID NO: 45513 - RNA, 22 nt, Homo sapiens
cccggcucccucgcucugcagg

SEQ ID NO: 45514 - RNA, 17 nt, Homo sapiens
gaggcggcggcggcggc

SEQ ID NO: 45515 - RNA, 22 nt, Homo sapiens
gcggaggaggaggaggcgccgc

SEQ ID NO: 45516 - RNA, 21 nt, Homo sapiens
acagccccgccaacagccaca

SEQ ID NO: 45517 - RNA, 18 nt, Homo sapiens
cccauagccccuuugcca

SEQ ID NO: 45518 - RNA, 18 nt, Homo sapiens
ccuacugggccgcugcca

SEQ ID NO: 45519 - RNA, 23 nt, Homo sapiens
ccugcccccgagacccagcccca

SEQ ID NO: 45520 - RNA, 18 nt, Homo sapiens
cuucucucccuccuccuc

SEQ ID NO: 45521 - RNA, 23 nt, Homo sapiens
uccugacguggcggagcugugga

SEQ ID NO: 45522 - RNA, 21 nt, Homo sapiens
ugcauccgcagcguggggcug

SEQ ID NO: 45523 - RNA, 22 nt, Homo sapiens
cccuggugacaccuuccuggag

SEQ ID NO: 45524 - RNA, 19 nt, Homo sapiens
guccaaacccaggaucuca

SEQ ID NO: 45525 - RNA, 20 nt, Homo sapiens
aaaguugccugcucuggcag

SEQ ID NO: 45526 - RNA, 15 nt, Homo sapiens
aggaaaagaaagcaa

SEQ ID NO: 45527 - RNA, 19 nt, Homo sapiens
cagcaggagccaagaggaa

SEQ ID NO: 45528 - RNA, 19 nt, Homo sapiens
caguaccaucucugccucc

SEQ ID NO: 45529 - RNA, 18 nt, Homo sapiens
ggagcuuuuuaaauuuca

SEQ ID NO: 45530 - RNA, 22 nt, Homo sapiens
cuguucucuuugguuuggaaua

SEQ ID NO: 45531 - RNA, 21 nt, Homo sapiens
gccuuuccuccauuuucugug

SEQ ID NO: 45532 - RNA, 18 nt, Homo sapiens
ggagcuuuuuaaaucuca

SEQ ID NO: 45533 - RNA, 18 nt, Homo sapiens
ugagcucuuccuuagcuc

SEQ ID NO: 45534 - RNA, 21 nt, Homo sapiens
uugcccaaaacuguucucuuu

SEQ ID NO: 45535 - RNA, 21 nt, Homo sapiens
gccuuuccuccauuuucugug

SEQ ID NO: 45536 - RNA, 18 nt, Homo sapiens
ggagcuuucuaaaucuca

SEQ ID NO: 45537 - RNA, 18 nt, Homo sapiens
ugagcucuucuauagcuc

SEQ ID NO: 45538 - RNA, 19 nt, Homo sapiens
uuuuucuuuuuucauuuca

SEQ ID NO: 45539 - RNA, 22 nt, Homo sapiens
cuuguugcugccccacacucca

SEQ ID NO: 45540 - RNA, 16 nt, Homo sapiens
gccugagccgccugcu

SEQ ID NO: 45541 - RNA, 20 nt, Homo sapiens
uucaagaccagccugaccaa

SEQ ID NO: 45542 - RNA, 19 nt, Homo sapiens
gggugauccacccgccucc

SEQ ID NO: 45543 - RNA, 20 nt, Homo sapiens
ugcacuccagccugggacug

SEQ ID NO: 45544 - RNA, 21 nt, Homo sapiens
aguggcuuugauuugggauua

SEQ ID NO: 45545 - RNA, 18 nt, Homo sapiens
ccagagcauccucaguga

SEQ ID NO: 45546 - RNA, 17 nt, Homo sapiens
ggaucaggagacaggaa

SEQ ID NO: 45547 - RNA, 20 nt, Homo sapiens
ucaugaguagggcaauagac

SEQ ID NO: 45548 - RNA, 21 nt, Homo sapiens
ugagaggcuggcauggaucua

SEQ ID NO: 45549 - RNA, 23 nt, Homo sapiens
uucaggagauuauauuucacuca

SEQ ID NO: 45550 - RNA, 28 nt, Homo sapiens
augcuauuucuuuuuuuuuucucuugac

SEQ ID NO: 45551 - RNA, 20 nt, Homo sapiens
aaugucuagcaugggaacua

SEQ ID NO: 45552 - RNA, 21 nt, Homo sapiens
cagaacuccuacauugccugg

SEQ ID NO: 45553 - RNA, 16 nt, Homo sapiens
ccucauuaagaccagu

SEQ ID NO: 45554 - RNA, 18 nt, Homo sapiens
acugacaagaagugugca

SEQ ID NO: 45555 - RNA, 20 nt, Homo sapiens
ccucugccucccagguucaa

SEQ ID NO: 45556 - RNA, 19 nt, Homo sapiens
gacugaggaaaacucucca

SEQ ID NO: 45557 - RNA, 19 nt, Homo sapiens
gugauacagcaaaaagcca

SEQ ID NO: 45558 - RNA, 18 nt, Homo sapiens
uucuccugcuucagccuu

SEQ ID NO: 45559 - RNA, 22 nt, Homo sapiens
aaggucaccugcacucccagcc

SEQ ID NO: 45560 - RNA, 23 nt, Homo sapiens
acuugaggucugacuuuuggcuc

SEQ ID NO: 45561 - RNA, 21 nt, Homo sapiens
caacaaguucuuguugacuca

SEQ ID NO: 45562 - RNA, 18 nt, Homo sapiens
gaggucugacuuuuggcu

SEQ ID NO: 45563 - RNA, 20 nt, Homo sapiens
guaaucuguugacagugcca

SEQ ID NO: 45564 - RNA, 19 nt, Homo sapiens
ucuuccucucuuuugcuca

SEQ ID NO: 45565 - RNA, 21 nt, Homo sapiens
ugggaacugauuugaccucga

SEQ ID NO: 45566 - RNA, 18 nt, Homo sapiens
ccgggcgagccucggauu

SEQ ID NO: 45567 - RNA, 19 nt, Homo sapiens
cgcgcggccgucgcaccug

SEQ ID NO: 45568 - RNA, 19 nt, Homo sapiens
cugcaaccuccgccuccca

SEQ ID NO: 45569 - RNA, 18 nt, Homo sapiens
uccgccucccagguucaa

SEQ ID NO: 45570 - RNA, 15 nt, Homo sapiens
gcaggauuccucucu

SEQ ID NO: 45571 - RNA, 19 nt, Homo sapiens
cauucaagucagcuuucac

SEQ ID NO: 45572 - RNA, 24 nt, Homo sapiens
uaaaaugcacagaauugccugcag

SEQ ID NO: 45573 - RNA, 21 nt, Homo sapiens
aagacuagguguuauccuaca

SEQ ID NO: 45574 - RNA, 19 nt, Homo sapiens
acaaaagcaugaucauuca

SEQ ID NO: 45575 - RNA, 21 nt, Homo sapiens
acuugaagccugaucuggccu

SEQ ID NO: 45576 - RNA, 19 nt, Homo sapiens
aguuccccuaguuacuaca

SEQ ID NO: 45577 - RNA, 19 nt, Homo sapiens
auucccccaauggacaaga

SEQ ID NO: 45578 - RNA, 22 nt, Homo sapiens
auucccugcagaagccgcagca

SEQ ID NO: 45579 - RNA, 19 nt, Homo sapiens
cuacaaguaugcugggaua

SEQ ID NO: 45580 - RNA, 21 nt, Homo sapiens
ggcucaucucugcugcaguaa

SEQ ID NO: 45581 - RNA, 19 nt, Homo sapiens
gggccgcccgcucgccucc

SEQ ID NO: 45582 - RNA, 20 nt, Homo sapiens
ucaugcccaaucuggaccaa

SEQ ID NO: 45583 - RNA, 17 nt, Homo sapiens
ugagccacaaaggcugg

SEQ ID NO: 45584 - RNA, 21 nt, Homo sapiens
ugaucucaccccuguacuuca

SEQ ID NO: 45585 - RNA, 19 nt, Homo sapiens
uugcugagagcaacuugca

SEQ ID NO: 45586 - RNA, 21 nt, Homo sapiens
aaacccgaaaccguuacaucu

SEQ ID NO: 45587 - RNA, 18 nt, Homo sapiens
acucucuggaaguucugg

SEQ ID NO: 45588 - RNA, 19 nt, Homo sapiens
agacaucacccacaagggg

SEQ ID NO: 45589 - RNA, 19 nt, Homo sapiens
cacacugauuacucacuca

SEQ ID NO: 45590 - RNA, 19 nt, Homo sapiens
cacucaccagccuccuucu

SEQ ID NO: 45591 - RNA, 19 nt, Homo sapiens
gagccaggaugaaauguca

SEQ ID NO: 45592 - RNA, 22 nt, Homo sapiens
ggagcgccugacgggcccaaca

SEQ ID NO: 45593 - RNA, 21 nt, Homo sapiens
aucuuacugguuguuaggccu

SEQ ID NO: 45594 - RNA, 21 nt, Homo sapiens
gccugaauaggcuccuggccc

SEQ ID NO: 45595 - RNA, 20 nt, Homo sapiens
gccccuuggggguucaggga

SEQ ID NO: 45596 - RNA, 20 nt, Homo sapiens
gccccuuggggguucaggga

SEQ ID NO: 45597 - RNA, 18 nt, Homo sapiens
ccgugaucccaucccaga

SEQ ID NO: 45598 - RNA, 17 nt, Homo sapiens
aaaaacaaacaaacaaa

SEQ ID NO: 45599 - RNA, 16 nt, Homo sapiens
aggcaucagguucugg

SEQ ID NO: 45600 - RNA, 16 nt, Homo sapiens
ucagcagcaucugcuc

SEQ ID NO: 45601 - RNA, 20 nt, Homo sapiens
ugucucaugccacauucucc

SEQ ID NO: 45602 - RNA, 20 nt, Homo sapiens
guguaugugagcggggagcu

SEQ ID NO: 45603 - RNA, 20 nt, Homo sapiens
ccacaaccucacguaaccuc

SEQ ID NO: 45604 - RNA, 23 nt, Homo sapiens
gggacgcagacggcggcggcggc

SEQ ID NO: 45605 - RNA, 18 nt, Homo sapiens
accugacuggagcucaga

SEQ ID NO: 45606 - RNA, 20 nt, Homo sapiens
aaaaaggaaagguucuucca

SEQ ID NO: 45607 - RNA, 20 nt, Homo sapiens
acgcuuacaccucugccuca

SEQ ID NO: 45608 - RNA, 21 nt, Homo sapiens
caacccugaccuucccccucc

SEQ ID NO: 45609 - RNA, 19 nt, Homo sapiens
cacugcccaccccucuuuu

SEQ ID NO: 45610 - RNA, 24 nt, Homo sapiens
cuuccauucccuuaaauucugagu

SEQ ID NO: 45611 - RNA, 21 nt, Homo sapiens
ggacuggugccuuugcauuca

SEQ ID NO: 45612 - RNA, 24 nt, Homo sapiens
gguaagagauaaacaguaacccuu

SEQ ID NO: 45613 - RNA, 19 nt, Homo sapiens
guaacugacuucacacagu

SEQ ID NO: 45614 - RNA, 25 nt, Homo sapiens
ucaccaacccugaccuucccccucc

SEQ ID NO: 45615 - RNA, 17 nt, Homo sapiens
uucccuuaaauucugag

SEQ ID NO: 45616 - RNA, 17 nt, Homo sapiens
aaccaaagguuuacuuu

SEQ ID NO: 45617 - RNA, 18 nt, Homo sapiens
caagagcauaggaguuuu

SEQ ID NO: 45618 - RNA, 19 nt, Homo sapiens
caugagaacuagaaaggaa

SEQ ID NO: 45619 - RNA, 22 nt, Homo sapiens
ccagauuaagguauuugucuaa

SEQ ID NO: 45620 - RNA, 24 nt, Homo sapiens
uagccuuuccaaaggagacaguca

SEQ ID NO: 45621 - RNA, 17 nt, Homo sapiens
ucuguaauugcuauugc

SEQ ID NO: 45622 - RNA, 18 nt, Homo sapiens
uggguggaucaccugagg

SEQ ID NO: 45623 - RNA, 23 nt, Homo sapiens
uugaauuuuuaaaguaaagcuca

SEQ ID NO: 45624 - RNA, 24 nt, Homo sapiens
uuuagugugccuggggucacuuuu

SEQ ID NO: 45625 - RNA, 19 nt, Homo sapiens
uaguguuugacuacugcua

SEQ ID NO: 45626 - RNA, 25 nt, Homo sapiens
ucacccuccugucccccccaccucc

SEQ ID NO: 45627 - RNA, 19 nt, Homo sapiens
accauugagaaugcgcagc

SEQ ID NO: 45628 - RNA, 21 nt, Homo sapiens
accucggugaccgccuggccu

SEQ ID NO: 45629 - RNA, 20 nt, Homo sapiens
caccauugagaaugcgcagc

SEQ ID NO: 45630 - RNA, 17 nt, Homo sapiens
uccagaggguguuccag

SEQ ID NO: 45631 - RNA, 19 nt, Homo sapiens
accugcaauuuugugcaca

SEQ ID NO: 45632 - RNA, 17 nt, Homo sapiens
cacaucuauuguuuccu

SEQ ID NO: 45633 - RNA, 23 nt, Homo sapiens
cagagacguggguacaaacccug

SEQ ID NO: 45634 - RNA, 20 nt, Homo sapiens
cugggauacacuccaaguca

SEQ ID NO: 45635 - RNA, 22 nt, Homo sapiens
cuguggauguuaaaccucguuu

SEQ ID NO: 45636 - RNA, 17 nt, Homo sapiens
acauuuuagaguucuga

SEQ ID NO: 45637 - RNA, 18 nt, Homo sapiens
guaaaaguuuuagccagc

SEQ ID NO: 45638 - RNA, 19 nt, Homo sapiens
caagagucaaccuggagca

SEQ ID NO: 45639 - RNA, 18 nt, Homo sapiens
ggaaaacaggguggccac

SEQ ID NO: 45640 - RNA, 19 nt, Homo sapiens
agaagucguggggggccca

SEQ ID NO: 45641 - RNA, 18 nt, Homo sapiens
ccaagucauccucccacc

SEQ ID NO: 45642 - RNA, 19 nt, Homo sapiens
agcagugcaaaggcccuga

SEQ ID NO: 45643 - RNA, 24 nt, Homo sapiens
cccagcucaagaaggcgcugcagg

SEQ ID NO: 45644 - RNA, 22 nt, Homo sapiens
ccugggccaccccacagcgggc

SEQ ID NO: 45645 - RNA, 19 nt, Homo sapiens
gucucacucugucgcccag

SEQ ID NO: 45646 - RNA, 16 nt, Homo sapiens
gugggauggcgaguga

SEQ ID NO: 45647 - RNA, 19 nt, Homo sapiens
aggccacucagauaaccuu

SEQ ID NO: 45648 - RNA, 19 nt, Homo sapiens
caucccucucaggcuccuu

SEQ ID NO: 45649 - RNA, 23 nt, Homo sapiens
guaagagacaacugggucuguuu

SEQ ID NO: 45650 - RNA, 21 nt, Homo sapiens
uaagagacaacugggucuguu

SEQ ID NO: 45651 - RNA, 22 nt, Homo sapiens
gcacagccacagagagcuccuc

SEQ ID NO: 45652 - RNA, 18 nt, Homo sapiens
gcugugucucccauucca

SEQ ID NO: 45653 - RNA, 23 nt, Homo sapiens
ggugagcacagccacagagagcu

SEQ ID NO: 45654 - RNA, 22 nt, Homo sapiens
ccaggggucaccgugugcacca

SEQ ID NO: 45655 - RNA, 17 nt, Homo sapiens
ccccggaugugcucagu

SEQ ID NO: 45656 - RNA, 22 nt, Homo sapiens
cugauggcucaacccaguccca

SEQ ID NO: 45657 - RNA, 20 nt, Homo sapiens
gggcucuuccaguccugcag

SEQ ID NO: 45658 - RNA, 17 nt, Homo sapiens
ggccuacaguugucguu

SEQ ID NO: 45659 - RNA, 17 nt, Homo sapiens
guguggacuucacccug

SEQ ID NO: 45660 - RNA, 16 nt, Homo sapiens
agaccagcuaccgcga

SEQ ID NO: 45661 - RNA, 24 nt, Homo sapiens
gccugaaggguucugcuguggucc

SEQ ID NO: 45662 - RNA, 18 nt, Homo sapiens
ucacgucugugcacuguc

SEQ ID NO: 45663 - RNA, 18 nt, Homo sapiens
ugcaaaacacacuggcuc

SEQ ID NO: 45664 - RNA, 20 nt, Homo sapiens
uccauuugcaaagguuacuu

SEQ ID NO: 45665 - RNA, 20 nt, Homo sapiens
aaacacaugcuguguuugaa

SEQ ID NO: 45666 - RNA, 22 nt, Homo sapiens
caccucuaccaauccaucuuca

SEQ ID NO: 45667 - RNA, 23 nt, Homo sapiens
cuuacagauuccaggucccuuuu

SEQ ID NO: 45668 - RNA, 22 nt, Homo sapiens
ggacuuaguuucaucuauugua

SEQ ID NO: 45669 - RNA, 24 nt, Homo sapiens
guuugaauuguggcugagagguuu

SEQ ID NO: 45670 - RNA, 18 nt, Homo sapiens
aaaucacccuuaaaucaa

SEQ ID NO: 45671 - RNA, 21 nt, Homo sapiens
auaugauauauuuucucuaaa

SEQ ID NO: 45672 - RNA, 22 nt, Homo sapiens
aucucggaauggaaaaagauca

SEQ ID NO: 45673 - RNA, 23 nt, Homo sapiens
ccuaggcaggcagacugagcuca

SEQ ID NO: 45674 - RNA, 17 nt, Homo sapiens
gguugcaauaccaaucu

SEQ ID NO: 45675 - RNA, 21 nt, Homo sapiens
acaaaagagagcaucucuucu

SEQ ID NO: 45676 - RNA, 21 nt, Homo sapiens
agugcccaacucuauaggcuu

SEQ ID NO: 45677 - RNA, 18 nt, Homo sapiens
cuccccacccucugccuc

SEQ ID NO: 45678 - RNA, 18 nt, Homo sapiens
gacagggaggacagggcc

SEQ ID NO: 45679 - RNA, 17 nt, Homo sapiens
ucuccucugcagcauga

SEQ ID NO: 45680 - RNA, 16 nt, Homo sapiens
ugccuugguugguuua

SEQ ID NO: 45681 - RNA, 24 nt, Homo sapiens
acagaggggauaacaacagcaaua

SEQ ID NO: 45682 - RNA, 21 nt, Homo sapiens
caagcacagguuagaguccca

SEQ ID NO: 45683 - RNA, 18 nt, Homo sapiens
cccaccagcugacaggca

SEQ ID NO: 45684 - RNA, 22 nt, Homo sapiens
cggccuacagcccgugcugcug

SEQ ID NO: 45685 - RNA, 22 nt, Homo sapiens
uaaauggaaggaauuggaacug

SEQ ID NO: 45686 - RNA, 17 nt, Homo sapiens
ucaugcaacaucuggac

SEQ ID NO: 45687 - RNA, 21 nt, Homo sapiens
agcuuaugcaacaugcucagc

SEQ ID NO: 45688 - RNA, 23 nt, Homo sapiens
caauacagguucaccaucauuaa

SEQ ID NO: 45689 - RNA, 19 nt, Homo sapiens
cacugcuuuccccaccagg

SEQ ID NO: 45690 - RNA, 20 nt, Homo sapiens
ucaccaucauuaacagcaaa

SEQ ID NO: 45691 - RNA, 23 nt, Homo sapiens
gacuaaaaucaaaauucugagaa

SEQ ID NO: 45692 - RNA, 19 nt, Homo sapiens
uccuggagaaacugcaggg

SEQ ID NO: 45693 - RNA, 21 nt, Homo sapiens
auccaggaguuucuccuuuuu

SEQ ID NO: 45694 - RNA, 23 nt, Homo sapiens
caucguauccaaaaggcucuuuu

SEQ ID NO: 45695 - RNA, 24 nt, Homo sapiens
aacuugaagaucucacagaccuaa

SEQ ID NO: 45696 - RNA, 19 nt, Homo sapiens
accaagcuacaauuagaga

SEQ ID NO: 45697 - RNA, 17 nt, Homo sapiens
cuuuccucucugccucu

SEQ ID NO: 45698 - RNA, 22 nt, Homo sapiens
gauuggagaaugguacaaacug

SEQ ID NO: 45699 - RNA, 19 nt, Homo sapiens
cccccaccccaaccccccu

SEQ ID NO: 45700 - RNA, 18 nt, Homo sapiens
cgccgaaggcuuugguga

SEQ ID NO: 45701 - RNA, 18 nt, Homo sapiens
ggagaggaggcugaggcc

SEQ ID NO: 45702 - RNA, 17 nt, Homo sapiens
aagcaagcccugcucac

SEQ ID NO: 45703 - RNA, 19 nt, Homo sapiens
uccaggucccuuguuccag

SEQ ID NO: 45704 - RNA, 21 nt, Homo sapiens
uccuggcuucagcaaugggcu

SEQ ID NO: 45705 - RNA, 18 nt, Homo sapiens
ugccaacucacugugaug

SEQ ID NO: 45706 - RNA, 22 nt, Homo sapiens
ugccuagggacaccuuuuccag

SEQ ID NO: 45707 - RNA, 19 nt, Homo sapiens
uuugggugaucucuuguca

SEQ ID NO: 45708 - RNA, 20 nt, Homo sapiens
acucacagauccacaccuga

SEQ ID NO: 45709 - RNA, 19 nt, Homo sapiens
guccacuggaggguccaga

SEQ ID NO: 45710 - RNA, 21 nt, Homo sapiens
ugugcagcuaccuaucugcug

SEQ ID NO: 45711 - RNA, 22 nt, Homo sapiens
acauaccuacccuuuucuaccu

SEQ ID NO: 45712 - RNA, 18 nt, Homo sapiens
guuucuguugcagaguua

SEQ ID NO: 45713 - RNA, 21 nt, Homo sapiens
uauuaugcucuugguguacca

SEQ ID NO: 45714 - RNA, 21 nt, Homo sapiens
caacauuuuccccaucccucu

SEQ ID NO: 45715 - RNA, 22 nt, Homo sapiens
caccccacacucccaccucuuu

SEQ ID NO: 45716 - RNA, 21 nt, Homo sapiens
ccaccccacacucccaccucu

SEQ ID NO: 45717 - RNA, 19 nt, Homo sapiens
cccaaaauccacauucucc

SEQ ID NO: 45718 - RNA, 17 nt, Homo sapiens
cggccccugugauccca

SEQ ID NO: 45719 - RNA, 19 nt, Homo sapiens
ucuaaccucaccucauucu

SEQ ID NO: 45720 - RNA, 16 nt, Homo sapiens
ucuggacaggagacac

SEQ ID NO: 45721 - RNA, 20 nt, Homo sapiens
agaagauuauguucuuguac

SEQ ID NO: 45722 - RNA, 16 nt, Homo sapiens
agccuccuacuaguac

SEQ ID NO: 45723 - RNA, 21 nt, Homo sapiens
cacuuugcagcccucaucuca

SEQ ID NO: 45724 - RNA, 25 nt, Homo sapiens
cgggcagcugccaccccgcccggcc

SEQ ID NO: 45725 - RNA, 22 nt, Homo sapiens
gcgucuuuucucuguggacucu

SEQ ID NO: 45726 - RNA, 20 nt, Homo sapiens
uggccccgccucuugcccca

SEQ ID NO: 45727 - RNA, 17 nt, Homo sapiens
gcgcccgccucgccucc

SEQ ID NO: 45728 - RNA, 26 nt, Homo sapiens
acaccaggagaauggcuucuccacca

SEQ ID NO: 45729 - RNA, 18 nt, Homo sapiens
caggagaauggcuucucc

SEQ ID NO: 45730 - RNA, 19 nt, Homo sapiens
cgccgcugagaccccgaga

SEQ ID NO: 45731 - RNA, 19 nt, Homo sapiens
gggaaaagcacuuccagca

SEQ ID NO: 45732 - RNA, 24 nt, Homo sapiens
gccuuucuuggcuggcaacacaca

SEQ ID NO: 45733 - RNA, 16 nt, Homo sapiens
cacaaaaaugucuucc

SEQ ID NO: 45734 - RNA, 17 nt, Homo sapiens
ccauugguuagcacacu

SEQ ID NO: 45735 - RNA, 20 nt, Homo sapiens
gagccaaucuuggaccuacc

SEQ ID NO: 45736 - RNA, 28 nt, Homo sapiens
gggcaaccagucgugaagacacgggaga

SEQ ID NO: 45737 - RNA, 21 nt, Homo sapiens
cuuugccuucgcagccgccuc

SEQ ID NO: 45738 - RNA, 20 nt, Homo sapiens
ccaguggcagcuuuuccugu

SEQ ID NO: 45739 - RNA, 18 nt, Homo sapiens
ccaguggcugccuugucc

SEQ ID NO: 45740 - RNA, 22 nt, Homo sapiens
cuuucuuccaggcccuugacug

SEQ ID NO: 45741 - RNA, 20 nt, Homo sapiens
ccccacccccaccccgcugc

SEQ ID NO: 45742 - RNA, 23 nt, Homo sapiens
cuggugauuaauuagcaauucuc

SEQ ID NO: 45743 - RNA, 20 nt, Homo sapiens
gccuggauugcucacuguuu

SEQ ID NO: 45744 - RNA, 22 nt, Homo sapiens
ucugagcgagcgcggugcuuuu

SEQ ID NO: 45745 - RNA, 18 nt, Homo sapiens
acugcaguuucuaccuga

SEQ ID NO: 45746 - RNA, 22 nt, Homo sapiens
acuucauccgcaggauuccagc

SEQ ID NO: 45747 - RNA, 19 nt, Homo sapiens
cccaccccugaccaccuca

SEQ ID NO: 45748 - RNA, 22 nt, Homo sapiens
ccugccccccaccagcaccuca

SEQ ID NO: 45749 - RNA, 23 nt, Homo sapiens
cucagugggggauacugcaaguu

SEQ ID NO: 45750 - RNA, 15 nt, Homo sapiens
cuucugccaugacug

SEQ ID NO: 45751 - RNA, 20 nt, Homo sapiens
ggcacacagcacuuaggcug

SEQ ID NO: 45752 - RNA, 19 nt, Homo sapiens
caaccgccuugcauccagu

SEQ ID NO: 45753 - RNA, 22 nt, Homo sapiens
acaugacgcaggcuucaccucu

SEQ ID NO: 45754 - RNA, 21 nt, Homo sapiens
gucacaguuaaugccagugcu

SEQ ID NO: 45755 - RNA, 17 nt, Homo sapiens
agacacucccacucgcc

SEQ ID NO: 45756 - RNA, 19 nt, Homo sapiens
gcacagguggcagcuggga

SEQ ID NO: 45757 - RNA, 19 nt, Homo sapiens
cuaagcgguuccaguuugu

SEQ ID NO: 45758 - RNA, 19 nt, Homo sapiens
guccacggauauuuugauc

SEQ ID NO: 45759 - RNA, 19 nt, Homo sapiens
aaaccuuuucuccccuuuc

SEQ ID NO: 45760 - RNA, 21 nt, Homo sapiens
acacugcagaaggaacugguu

SEQ ID NO: 45761 - RNA, 19 nt, Homo sapiens
agaggagaaauaaaaccuu

SEQ ID NO: 45762 - RNA, 18 nt, Homo sapiens
agcaccaucuguuccccu

SEQ ID NO: 45763 - RNA, 21 nt, Homo sapiens
agccaagggagcagggucauu

SEQ ID NO: 45764 - RNA, 18 nt, Homo sapiens
cacacaggcacccaccca

SEQ ID NO: 45765 - RNA, 19 nt, Homo sapiens
cauugguguguuuagagau

SEQ ID NO: 45766 - RNA, 19 nt, Homo sapiens
ccagcuauccucgcacuca

SEQ ID NO: 45767 - RNA, 20 nt, Homo sapiens
ccuggcaccccacccacucc

SEQ ID NO: 45768 - RNA, 18 nt, Homo sapiens
cuccuguuguuuggccuu

SEQ ID NO: 45769 - RNA, 19 nt, Homo sapiens
gugcugcgcucuugggccc

SEQ ID NO: 45770 - RNA, 23 nt, Homo sapiens
ugacggacucagcacucccgccu

SEQ ID NO: 45771 - RNA, 18 nt, Homo sapiens
ugcugcucccugcuccuc

SEQ ID NO: 45772 - RNA, 16 nt, Homo sapiens
uuggaugcugccuuac

SEQ ID NO: 45773 - RNA, 19 nt, Homo sapiens
aguggguggggagguggug

SEQ ID NO: 45774 - RNA, 19 nt, Homo sapiens
agaaccucuccaucuccuc

SEQ ID NO: 45775 - RNA, 22 nt, Homo sapiens
agagcaacaguauuccucaauc

SEQ ID NO: 45776 - RNA, 22 nt, Homo sapiens
ccacaaagaaccucuccaucuc

SEQ ID NO: 45777 - RNA, 22 nt, Homo sapiens
ccuaaaaacuaugacugccuuu

SEQ ID NO: 45778 - RNA, 21 nt, Homo sapiens
ugcuauuuuuuuuaauuugac

SEQ ID NO: 45779 - RNA, 23 nt, Homo sapiens
acuugcgugguggccccuggccc

SEQ ID NO: 45780 - RNA, 16 nt, Homo sapiens
agcaccgucugcuccu

SEQ ID NO: 45781 - RNA, 21 nt, Homo sapiens
gaggccuucagccccucgcuc

SEQ ID NO: 45782 - RNA, 16 nt, Homo sapiens
gcaccgucugcuccuc

SEQ ID NO: 45783 - RNA, 22 nt, Homo sapiens
gugcugcgggcgagggccccgg

SEQ ID NO: 45784 - RNA, 22 nt, Homo sapiens
ucugagcccuaggauuuggccc

SEQ ID NO: 45785 - RNA, 22 nt, Homo sapiens
ucuuuucgaagcuguuaauuuu

SEQ ID NO: 45786 - RNA, 18 nt, Homo sapiens
ccugucucccucucugaa

SEQ ID NO: 45787 - RNA, 23 nt, Homo sapiens
uaaaaaagcuggugggugaaaga

SEQ ID NO: 45788 - RNA, 21 nt, Homo sapiens
uuucaauaacgaaguugggca

SEQ ID NO: 45789 - RNA, 22 nt, Homo sapiens
uuuccaaaaaccaugucuccca

SEQ ID NO: 45790 - RNA, 17 nt, Homo sapiens
aacuuugcacgucugcc

SEQ ID NO: 45791 - RNA, 23 nt, Homo sapiens
cccccaaccccagcccuuccgua

SEQ ID NO: 45792 - RNA, 20 nt, Homo sapiens
guuucucccuuuuguguauu

SEQ ID NO: 45793 - RNA, 20 nt, Homo sapiens
ucucuucauauauccaaaga

SEQ ID NO: 45794 - RNA, 21 nt, Homo sapiens
ucuuuguaucugaacuuugca

SEQ ID NO: 45795 - RNA, 16 nt, Homo sapiens
acugagcagcauuaca

SEQ ID NO: 45796 - RNA, 20 nt, Homo sapiens
agugaacuauuuguuccugg

SEQ ID NO: 45797 - RNA, 22 nt, Homo sapiens
cugagcagcauuacacuacaau

SEQ ID NO: 45798 - RNA, 20 nt, Homo sapiens
ggccugaaucuuccauuuua

SEQ ID NO: 45799 - RNA, 22 nt, Homo sapiens
gguaauagcauauuacagcuga

SEQ ID NO: 45800 - RNA, 19 nt, Homo sapiens
uggcuaaaauuaacuuuag

SEQ ID NO: 45801 - RNA, 18 nt, Homo sapiens
ugguuauuggagaacuuu

SEQ ID NO: 45802 - RNA, 21 nt, Homo sapiens
aaaccaauugaaagcguccca

SEQ ID NO: 45803 - RNA, 20 nt, Homo sapiens
uaacacuuugaucucauuaa

SEQ ID NO: 45804 - RNA, 22 nt, Homo sapiens
acuccagaugaaaaaaacuugc

SEQ ID NO: 45805 - RNA, 20 nt, Homo sapiens
gccuccgaucgcugugguuc

SEQ ID NO: 45806 - RNA, 23 nt, Homo sapiens
ggcaguauauaaauggugcuuua

SEQ ID NO: 45807 - RNA, 19 nt, Homo sapiens
cucugagugcagggccugc

SEQ ID NO: 45808 - RNA, 21 nt, Homo sapiens
gcuguaauacaguuggcaguu

SEQ ID NO: 45809 - RNA, 18 nt, Homo sapiens
acuggugggcugcaggga

SEQ ID NO: 45810 - RNA, 21 nt, Homo sapiens
cagaagagggugaguccugga

SEQ ID NO: 45811 - RNA, 18 nt, Homo sapiens
ccgcaccgccucacaacc

SEQ ID NO: 45812 - RNA, 18 nt, Homo sapiens
ccugcaaccuccaccucc

SEQ ID NO: 45813 - RNA, 18 nt, Homo sapiens
ccugcuucccaaacccca

SEQ ID NO: 45814 - RNA, 17 nt, Homo sapiens
cgggcuggaacacagca

SEQ ID NO: 45815 - RNA, 20 nt, Homo sapiens
gaaucuccaugucccaugaa

SEQ ID NO: 45816 - RNA, 18 nt, Homo sapiens
gagccccgguuuucccau

SEQ ID NO: 45817 - RNA, 21 nt, Homo sapiens
gugccaggugcugggggcucu

SEQ ID NO: 45818 - RNA, 20 nt, Homo sapiens
uacuggugggaagcacugug

SEQ ID NO: 45819 - RNA, 18 nt, Homo sapiens
uccaccucccggguucaa

SEQ ID NO: 45820 - RNA, 22 nt, Homo sapiens
ugcccagggcucccccacccag

SEQ ID NO: 45821 - RNA, 18 nt, Homo sapiens
cauuuccccaggccaagu

SEQ ID NO: 45822 - RNA, 19 nt, Homo sapiens
ccucucugggccugugcag

SEQ ID NO: 45823 - RNA, 21 nt, Homo sapiens
ccuugguaacugauggacuca

SEQ ID NO: 45824 - RNA, 18 nt, Homo sapiens
gaccuuagcauggggcua

SEQ ID NO: 45825 - RNA, 18 nt, Homo sapiens
gaccuuagcauggggcua

SEQ ID NO: 45826 - RNA, 16 nt, Homo sapiens
gaggcuguuucucaca

SEQ ID NO: 45827 - RNA, 24 nt, Homo sapiens
aaagugcaacaggcaauugaaucc

SEQ ID NO: 45828 - RNA, 23 nt, Homo sapiens
aauguuagacuuuuucaucugcc

SEQ ID NO: 45829 - RNA, 20 nt, Homo sapiens
accagcagccuauuacaagc

SEQ ID NO: 45830 - RNA, 19 nt, Homo sapiens
acuacagggauuuugucau

SEQ ID NO: 45831 - RNA, 22 nt, Homo sapiens
ccacuucuuuuuuccuaaauaa

SEQ ID NO: 45832 - RNA, 22 nt, Homo sapiens
gaaaaaucaucuagugugugac

SEQ ID NO: 45833 - RNA, 16 nt, Homo sapiens
gacauaguacauguac

SEQ ID NO: 45834 - RNA, 23 nt, Homo sapiens
gccuuuguuuauuuaaacaugaa

SEQ ID NO: 45835 - RNA, 22 nt, Homo sapiens
uugaaugauggaaaucuuauua

SEQ ID NO: 45836 - RNA, 19 nt, Homo sapiens
uuuguuuauuuaaacauga

SEQ ID NO: 45837 - RNA, 18 nt, Homo sapiens
ccaucuauacaaacuaua

SEQ ID NO: 45838 - RNA, 23 nt, Homo sapiens
uggcccaucaccaccaucaacua

SEQ ID NO: 45839 - RNA, 19 nt, Homo sapiens
aagcaauucuccugccuca

SEQ ID NO: 45840 - RNA, 19 nt, Homo sapiens
aauaggcaauauuaauaca

SEQ ID NO: 45841 - RNA, 18 nt, Homo sapiens
agauccuaaucuacugca

SEQ ID NO: 45842 - RNA, 24 nt, Homo sapiens
augggcccuguuuccagugugagg

SEQ ID NO: 45843 - RNA, 19 nt, Homo sapiens
ccauuuccucucagaagca

SEQ ID NO: 45844 - RNA, 22 nt, Homo sapiens
ccauuucucugaacuccaguaa

SEQ ID NO: 45845 - RNA, 23 nt, Homo sapiens
ccucugucucagcauugggacug

SEQ ID NO: 45846 - RNA, 19 nt, Homo sapiens
cugcaaccucugccuccca

SEQ ID NO: 45847 - RNA, 21 nt, Homo sapiens
gagcucuguggaaacagaauc

SEQ ID NO: 45848 - RNA, 24 nt, Homo sapiens
uagaaucuaaaaauucauguugaa

SEQ ID NO: 45849 - RNA, 18 nt, Homo sapiens
ugagccacaucacaguau

SEQ ID NO: 45850 - RNA, 18 nt, Homo sapiens
uuauaaauagucaugaua

SEQ ID NO: 45851 - RNA, 19 nt, Homo sapiens
uuggauuuauaccaacaaa

SEQ ID NO: 45852 - RNA, 20 nt, Homo sapiens
gaauuuauuaguggaggaug

SEQ ID NO: 45853 - RNA, 17 nt, Homo sapiens
aaaaacaaacaaacaaa

SEQ ID NO: 45854 - RNA, 17 nt, Homo sapiens
acccuacuuauucuuca

SEQ ID NO: 45855 - RNA, 24 nt, Homo sapiens
uuaucucccaugcauccuuucuca

SEQ ID NO: 45856 - RNA, 17 nt, Homo sapiens
uucaaagucagaugaca

SEQ ID NO: 45857 - RNA, 19 nt, Homo sapiens
uuccagagaccuaucucag

SEQ ID NO: 45858 - RNA, 19 nt, Homo sapiens
aagaaacuuuuuuuccuuc

SEQ ID NO: 45859 - RNA, 22 nt, Homo sapiens
aguuuuaaauacauggaaggaa

SEQ ID NO: 45860 - RNA, 20 nt, Homo sapiens
aucggcagcuugacacccac

SEQ ID NO: 45861 - RNA, 19 nt, Homo sapiens
gcgcgccggccgcgcucug

SEQ ID NO: 45862 - RNA, 18 nt, Homo sapiens
ucugcugauauuugugga

SEQ ID NO: 45863 - RNA, 18 nt, Homo sapiens
cuuuucccuuuaggccug

SEQ ID NO: 45864 - RNA, 20 nt, Homo sapiens
gacuuuggauuccuugacca

SEQ ID NO: 45865 - RNA, 21 nt, Homo sapiens
gcgaagauggucucgaucucc

SEQ ID NO: 45866 - RNA, 23 nt, Homo sapiens
gcuugagccacugcgcccggccu

SEQ ID NO: 45867 - RNA, 21 nt, Homo sapiens
gcuuuuuacugguuuauacug

SEQ ID NO: 45868 - RNA, 20 nt, Homo sapiens
uggucaggcuggucuugaac

SEQ ID NO: 45869 - RNA, 23 nt, Homo sapiens
uuaaaacacuccaguuacuuuuc

SEQ ID NO: 45870 - RNA, 23 nt, Homo sapiens
ggcaaauguuaaaacacacuuua

SEQ ID NO: 45871 - RNA, 20 nt, Homo sapiens
acaaaacagaacaagucuca

SEQ ID NO: 45872 - RNA, 24 nt, Homo sapiens
cacuugguuuuaauaaauuacuca

SEQ ID NO: 45873 - RNA, 20 nt, Homo sapiens
cuguuauauacucagugcaa

SEQ ID NO: 45874 - RNA, 17 nt, Homo sapiens
gucaucuaaaagcuuuu

SEQ ID NO: 45875 - RNA, 20 nt, Homo sapiens
ucagauguguuugguaauca

SEQ ID NO: 45876 - RNA, 19 nt, Homo sapiens
ugaacauaaguucauuucc

SEQ ID NO: 45877 - RNA, 19 nt, Homo sapiens
acuucaucaaagauuugcu

SEQ ID NO: 45878 - RNA, 18 nt, Homo sapiens
cagaaaagguuacacaug

SEQ ID NO: 45879 - RNA, 21 nt, Homo sapiens
gcgccugggccggcgggucuu

SEQ ID NO: 45880 - RNA, 16 nt, Homo sapiens
ucuucaguauuugcuu

SEQ ID NO: 45881 - RNA, 17 nt, Homo sapiens
uugcucgugucuguuga

SEQ ID NO: 45882 - RNA, 25 nt, Homo sapiens
uuuggaaauggcuguuuuuaauuuu

SEQ ID NO: 45883 - RNA, 21 nt, Homo sapiens
cacguggccaaggccccgcag

SEQ ID NO: 45884 - RNA, 19 nt, Homo sapiens
ucaguguuuugccaauuaa

SEQ ID NO: 45885 - RNA, 23 nt, Homo sapiens
uugaauuccaugguuaaaucuca

SEQ ID NO: 45886 - RNA, 25 nt, Homo sapiens
gcccccgacgccgccgagcacguca

SEQ ID NO: 45887 - RNA, 21 nt, Homo sapiens
aggcacagcuccaucauuaca

SEQ ID NO: 45888 - RNA, 22 nt, Homo sapiens
ccaccagucccagaacccgcca

SEQ ID NO: 45889 - RNA, 18 nt, Homo sapiens
cgguuccuggagcugggc

SEQ ID NO: 45890 - RNA, 17 nt, Homo sapiens
cugccucacaacaaccu

SEQ ID NO: 45891 - RNA, 18 nt, Homo sapiens
ggcacagcuccucccuca

SEQ ID NO: 45892 - RNA, 19 nt, Homo sapiens
uaaguggauuccagagggg

SEQ ID NO: 45893 - RNA, 20 nt, Homo sapiens
aauaaaauucccaacagcuu

SEQ ID NO: 45894 - RNA, 19 nt, Homo sapiens
auaaucauauauacgugua

SEQ ID NO: 45895 - RNA, 25 nt, Homo sapiens
auauauuugcugcugugacauuuca

SEQ ID NO: 45896 - RNA, 21 nt, Homo sapiens
caaaacauuuucaguuuauca

SEQ ID NO: 45897 - RNA, 17 nt, Homo sapiens
gaguaauugucaaguga

SEQ ID NO: 45898 - RNA, 20 nt, Homo sapiens
gugucuauauacacacgugg

SEQ ID NO: 45899 - RNA, 17 nt, Homo sapiens
uaaucauauauacgugu

SEQ ID NO: 45900 - RNA, 24 nt, Homo sapiens
ucuacaaagaaaaccagcauaaaa

SEQ ID NO: 45901 - RNA, 18 nt, Homo sapiens
uucccaacagcuuccacu

SEQ ID NO: 45902 - RNA, 22 nt, Homo sapiens
uuuugaccauggacuuugugga

SEQ ID NO: 45903 - RNA, 22 nt, Homo sapiens
agugaugaccaaaagaaccaga

SEQ ID NO: 45904 - RNA, 19 nt, Homo sapiens
uaauaucugacuggccucc

SEQ ID NO: 45905 - RNA, 18 nt, Homo sapiens
gaguugcgacgggcgucg

SEQ ID NO: 45906 - RNA, 20 nt, Homo sapiens
ucugcuggaguccugauggg

SEQ ID NO: 45907 - RNA, 17 nt, Homo sapiens
agaaaugaaccaccgca

SEQ ID NO: 45908 - RNA, 19 nt, Homo sapiens
agaaaacuguaauuuuaaa

SEQ ID NO: 45909 - RNA, 27 nt, Homo sapiens
ccuaauuuguuuuuccaaaucauuuuu

SEQ ID NO: 45910 - RNA, 17 nt, Homo sapiens
uuuauagaugcagcacc

SEQ ID NO: 45911 - RNA, 21 nt, Homo sapiens
aucugaaucagaaguuugcuc

SEQ ID NO: 45912 - RNA, 23 nt, Homo sapiens
gcaacuuagcgaagcugccggug

SEQ ID NO: 45913 - RNA, 26 nt, Homo sapiens
uaggugggaauaugguugugggauua

SEQ ID NO: 45914 - RNA, 20 nt, Homo sapiens
caaaaugacauuuugccaaa

SEQ ID NO: 45915 - RNA, 17 nt, Homo sapiens
gucccccuagagacuca

SEQ ID NO: 45916 - RNA, 19 nt, Homo sapiens
aagcaguacuggcauaaaa

SEQ ID NO: 45917 - RNA, 17 nt, Homo sapiens
aaggggccguggaagcu

SEQ ID NO: 45918 - RNA, 21 nt, Homo sapiens
augguguugaguggcaugcuc

SEQ ID NO: 45919 - RNA, 24 nt, Homo sapiens
caaaauaguaguaacaaauauaua

SEQ ID NO: 45920 - RNA, 21 nt, Homo sapiens
ccuuggcuaaaggucugggga

SEQ ID NO: 45921 - RNA, 21 nt, Homo sapiens
ccuuggcuaaaggucugggga

SEQ ID NO: 45922 - RNA, 21 nt, Homo sapiens
uuugccuuugcgaaccauuuc

SEQ ID NO: 45923 - RNA, 18 nt, Homo sapiens
agaaaacaaaacuggcaa

SEQ ID NO: 45924 - RNA, 19 nt, Homo sapiens
auguacuuaugguaagcua

SEQ ID NO: 45925 - RNA, 21 nt, Homo sapiens
cagaguuggggcauugaggaa

SEQ ID NO: 45926 - RNA, 21 nt, Homo sapiens
cucuuucucucccuccuccuc

SEQ ID NO: 45927 - RNA, 22 nt, Homo sapiens
gaauucagugaauauucauuaa

SEQ ID NO: 45928 - RNA, 19 nt, Homo sapiens
ggaaugagccugcuguggc

SEQ ID NO: 45929 - RNA, 17 nt, Homo sapiens
uccagaaaugcugucca

SEQ ID NO: 45930 - RNA, 19 nt, Homo sapiens
uaaagaauauuucccaugc

SEQ ID NO: 45931 - RNA, 22 nt, Homo sapiens
gacgcuguggcucacaccugua

SEQ ID NO: 45932 - RNA, 20 nt, Homo sapiens
aaacacaugcuguguuugaa

SEQ ID NO: 45933 - RNA, 22 nt, Homo sapiens
caccucuaccaauccaucuuca

SEQ ID NO: 45934 - RNA, 23 nt, Homo sapiens
cuuacagauuccaggucccuuuu

SEQ ID NO: 45935 - RNA, 22 nt, Homo sapiens
ggacuuaguuucaucuauugua

SEQ ID NO: 45936 - RNA, 24 nt, Homo sapiens
guuugaauuguggcugagagguuu

SEQ ID NO: 45937 - RNA, 18 nt, Homo sapiens
uagcugucuccagucuga

SEQ ID NO: 45938 - RNA, 20 nt, Homo sapiens
gacccuccagcagcugggca

SEQ ID NO: 45939 - RNA, 19 nt, Homo sapiens
uuugagguggggccuggag

SEQ ID NO: 45940 - RNA, 23 nt, Homo sapiens
cucccccagcugcagugguccca

SEQ ID NO: 45941 - RNA, 19 nt, Homo sapiens
gcucuggcccaggguggca

SEQ ID NO: 45942 - RNA, 17 nt, Homo sapiens
ccucccuacuugcugcu

SEQ ID NO: 45943 - RNA, 21 nt, Homo sapiens
ugcugucauauaaucauucca

SEQ ID NO: 45944 - RNA, 19 nt, Homo sapiens
accacauuuaaacacuguu

SEQ ID NO: 45945 - RNA, 24 nt, Homo sapiens
cagaagaauugaggaucugaugga

SEQ ID NO: 45946 - RNA, 22 nt, Homo sapiens
gcaucaaauguacauuauuuca

SEQ ID NO: 45947 - RNA, 17 nt, Homo sapiens
ggcggucgagcugggcc

SEQ ID NO: 45948 - RNA, 20 nt, Homo sapiens
aggagggcgaguggcgagca

SEQ ID NO: 45949 - RNA, 23 nt, Homo sapiens
acagagaagaggagaccccaaca

SEQ ID NO: 45950 - RNA, 19 nt, Homo sapiens
uucuggaucccagcagugu

SEQ ID NO: 45951 - RNA, 20 nt, Homo sapiens
ccaguggcaaugcuuuguua

SEQ ID NO: 45952 - RNA, 19 nt, Homo sapiens
accucauaguaugaaauua

SEQ ID NO: 45953 - RNA, 23 nt, Homo sapiens
acagagaagaggagaccccaaca

SEQ ID NO: 45954 - RNA, 19 nt, Homo sapiens
uucuggaucccagcagugu

SEQ ID NO: 45955 - RNA, 20 nt, Homo sapiens
cuccucgggcacacggugaa

SEQ ID NO: 45956 - RNA, 20 nt, Homo sapiens
gggcuaggcugggccggguu

SEQ ID NO: 45957 - RNA, 20 nt, Homo sapiens
aauugaaucuggauacaucu

SEQ ID NO: 45958 - RNA, 18 nt, Homo sapiens
cucugggagauaauacac

SEQ ID NO: 45959 - RNA, 20 nt, Homo sapiens
cuugggagaggaauuauuuu

SEQ ID NO: 45960 - RNA, 19 nt, Homo sapiens
ccuucccaguuucucccca

SEQ ID NO: 45961 - RNA, 21 nt, Homo sapiens
cuuccuugaucuauuaugacu

SEQ ID NO: 45962 - RNA, 19 nt, Homo sapiens
cuuugacuguuuuagcuuu

SEQ ID NO: 45963 - RNA, 23 nt, Homo sapiens
augccuuagcuuccucccgccgc

SEQ ID NO: 45964 - RNA, 18 nt, Homo sapiens
uggaaaugccugccccag

SEQ ID NO: 45965 - RNA, 18 nt, Homo sapiens
uggaaaugccugccccag

SEQ ID NO: 45966 - RNA, 21 nt, Homo sapiens
acccugaacuccccaugugau

SEQ ID NO: 45967 - RNA, 19 nt, Homo sapiens
cacaucacguucaguguuu

SEQ ID NO: 45968 - RNA, 18 nt, Homo sapiens
guguguucguacuccagg

SEQ ID NO: 45969 - RNA, 25 nt, Homo sapiens
uguggggauuaaagugcugcgggug

SEQ ID NO: 45970 - RNA, 22 nt, Homo sapiens
acccagagagaaaaagcauccc

SEQ ID NO: 45971 - RNA, 18 nt, Homo sapiens
cucacaguuaggcuuuua

SEQ ID NO: 45972 - RNA, 18 nt, Homo sapiens
ggagccgucuuuuacuca

SEQ ID NO: 45973 - RNA, 18 nt, Homo sapiens
ugcccacuucucaucucu

SEQ ID NO: 45974 - RNA, 16 nt, Homo sapiens
uuccugugccucccuc

SEQ ID NO: 45975 - RNA, 21 nt, Homo sapiens
aacacaaugguucuuacuguu

SEQ ID NO: 45976 - RNA, 17 nt, Homo sapiens
aggaaggaaaaaagcaa

SEQ ID NO: 45977 - RNA, 17 nt, Homo sapiens
cugcuuugccuacucuc

SEQ ID NO: 45978 - RNA, 18 nt, Homo sapiens
ucaaaaacaauugagcau

SEQ ID NO: 45979 - RNA, 23 nt, Homo sapiens
uggucucaaacuccuggguucaa

SEQ ID NO: 45980 - RNA, 19 nt, Homo sapiens
ugucaucaucaauuccauu

SEQ ID NO: 45981 - RNA, 19 nt, Homo sapiens
cgaagugucaggcgcgucu

SEQ ID NO: 45982 - RNA, 16 nt, Homo sapiens
gaugacuaacacaacu

SEQ ID NO: 45983 - RNA, 24 nt, Homo sapiens
uaaaauaagagcuguagcuaccaa

SEQ ID NO: 45984 - RNA, 19 nt, Homo sapiens
gcggcggcuggaacaauca

SEQ ID NO: 45985 - RNA, 23 nt, Homo sapiens
uggcaaagcaaccuuaagcucua

SEQ ID NO: 45986 - RNA, 19 nt, Homo sapiens
cacaagugaggauacguaa

SEQ ID NO: 45987 - RNA, 21 nt, Homo sapiens
gaaacccuuuucugucgcguc

SEQ ID NO: 45988 - RNA, 18 nt, Homo sapiens
acccauggcauggagcug

SEQ ID NO: 45989 - RNA, 16 nt, Homo sapiens
ugacugcugcaaguga

SEQ ID NO: 45990 - RNA, 22 nt, Homo sapiens
uggcuucccccagcgugagacu

SEQ ID NO: 45991 - RNA, 25 nt, Homo sapiens
acccagaaucaccacugccacuuuu

SEQ ID NO: 45992 - RNA, 19 nt, Homo sapiens
aguacaauauugccgaugc

SEQ ID NO: 45993 - RNA, 17 nt, Homo sapiens
auaaaaucagccacucu

SEQ ID NO: 45994 - RNA, 16 nt, Homo sapiens
ugguuugagaacuuua

SEQ ID NO: 45995 - RNA, 20 nt, Homo sapiens
guccuuuaaaacagaaugga

SEQ ID NO: 45996 - RNA, 22 nt, Homo sapiens
agcuuuucuaccugucccugua

SEQ ID NO: 45997 - RNA, 24 nt, Homo sapiens
cagguguggggcugggcaugguca

SEQ ID NO: 45998 - RNA, 22 nt, Homo sapiens
agcuuuucuaccugucccugua

SEQ ID NO: 45999 - RNA, 24 nt, Homo sapiens
cagguguggggcugggcaugguca

SEQ ID NO: 46000 - RNA, 18 nt, Homo sapiens
ggaagugucaucauagua

SEQ ID NO: 46001 - RNA, 18 nt, Homo sapiens
guaaacagaaaacugcac

SEQ ID NO: 46002 - RNA, 19 nt, Homo sapiens
ccugggagcuccacacaaa

SEQ ID NO: 46003 - RNA, 17 nt, Homo sapiens
cucaacaauggucuuuu

SEQ ID NO: 46004 - RNA, 21 nt, Homo sapiens
gcucugaggauccggccucac

SEQ ID NO: 46005 - RNA, 21 nt, Homo sapiens
gcucugaggauccggccucac

SEQ ID NO: 46006 - RNA, 18 nt, Homo sapiens
aacucccucaucugagaa

SEQ ID NO: 46007 - RNA, 16 nt, Homo sapiens
agagauugucauuccc

SEQ ID NO: 46008 - RNA, 16 nt, Homo sapiens
agcccugcuucccgca

SEQ ID NO: 46009 - RNA, 17 nt, Homo sapiens
agggacauuuuaucuca

SEQ ID NO: 46010 - RNA, 18 nt, Homo sapiens
auuccagaguucauucca

SEQ ID NO: 46011 - RNA, 22 nt, Homo sapiens
auugucuuaauucccuaacgaa

SEQ ID NO: 46012 - RNA, 18 nt, Homo sapiens
cagcagaguuaccacuga

SEQ ID NO: 46013 - RNA, 21 nt, Homo sapiens
ucagcaggaaaucaaugugga

SEQ ID NO: 46014 - RNA, 17 nt, Homo sapiens
uuuccugauagcugcag

SEQ ID NO: 46015 - RNA, 22 nt, Homo sapiens
cgggcgcaucacgaggucagga

SEQ ID NO: 46016 - RNA, 20 nt, Homo sapiens
uaaggguugacaccauucuc

SEQ ID NO: 46017 - RNA, 21 nt, Homo sapiens
aacauccccccaccuccauuu

SEQ ID NO: 46018 - RNA, 20 nt, Homo sapiens
agcuaccaugcaggccacag

SEQ ID NO: 46019 - RNA, 18 nt, Homo sapiens
auccgauccuccccuucc

SEQ ID NO: 46020 - RNA, 18 nt, Homo sapiens
ccuguaccacccacucca

SEQ ID NO: 46021 - RNA, 17 nt, Homo sapiens
aaacacugaaaaacauc

SEQ ID NO: 46022 - RNA, 18 nt, Homo sapiens
guggauggaaaaguugug

SEQ ID NO: 46023 - RNA, 21 nt, Homo sapiens
uggauggaaaaguuguggaac

SEQ ID NO: 46024 - RNA, 18 nt, Homo sapiens
aacuagagucagaacgaa

SEQ ID NO: 46025 - RNA, 20 nt, Homo sapiens
ccuaucuguuugcugugaua

SEQ ID NO: 46026 - RNA, 18 nt, Homo sapiens
gccuauuaagaggcuuuu

SEQ ID NO: 46027 - RNA, 17 nt, Homo sapiens
agguagccugaacuuug

SEQ ID NO: 46028 - RNA, 19 nt, Homo sapiens
cagauguugaauccucuaa

SEQ ID NO: 46029 - RNA, 19 nt, Homo sapiens
ucaccuaucugagccacaa

SEQ ID NO: 46030 - RNA, 22 nt, Homo sapiens
caaacuagcuaaaggaaaccaa

SEQ ID NO: 46031 - RNA, 28 nt, Homo sapiens
gccuaaaugcuuuaguuuuaggucauuu

SEQ ID NO: 46032 - RNA, 20 nt, Homo sapiens
gcucauuucaggaaaaccua

SEQ ID NO: 46033 - RNA, 24 nt, Homo sapiens
guagcuuuaacaacuuuucuguua

SEQ ID NO: 46034 - RNA, 23 nt, Homo sapiens
uaagaacuggagcaaguacucuu

SEQ ID NO: 46035 - RNA, 16 nt, Homo sapiens
ugaacuuuguuuccca

SEQ ID NO: 46036 - RNA, 23 nt, Homo sapiens
uuucuuuauagagaaaguaccuu

SEQ ID NO: 46037 - RNA, 19 nt, Homo sapiens
auugacaagcccuucugau

SEQ ID NO: 46038 - RNA, 20 nt, Homo sapiens
gcaucuacaccguuaccuca

SEQ ID NO: 46039 - RNA, 21 nt, Homo sapiens
ucaucaccagcgacugcugua

SEQ ID NO: 46040 - RNA, 21 nt, Homo sapiens
ccgugucugacaaagacucug

SEQ ID NO: 46041 - RNA, 22 nt, Homo sapiens
gaguucacagaaacagaugcca

SEQ ID NO: 46042 - RNA, 22 nt, Homo sapiens
uucaaguggugcugaauccuca

SEQ ID NO: 46043 - RNA, 18 nt, Homo sapiens
cagcagacccccaucaua

SEQ ID NO: 46044 - RNA, 17 nt, Homo sapiens
aguuuugaaacaguuac

SEQ ID NO: 46045 - RNA, 18 nt, Homo sapiens
caaccccacaaagugaca

SEQ ID NO: 46046 - RNA, 19 nt, Homo sapiens
gcuggucaagcacgugaca

SEQ ID NO: 46047 - RNA, 22 nt, Homo sapiens
augucaccaauguacucgccca

SEQ ID NO: 46048 - RNA, 21 nt, Homo sapiens
guggaaggagccaggguggca

SEQ ID NO: 46049 - RNA, 21 nt, Homo sapiens
auugcaccaaguucugugaca

SEQ ID NO: 46050 - RNA, 17 nt, Homo sapiens
ccaacuccggcaccuuc

SEQ ID NO: 46051 - RNA, 21 nt, Homo sapiens
ccccgguccccgcagccagga

SEQ ID NO: 46052 - RNA, 19 nt, Homo sapiens
cgcgcggcggggucccugc

SEQ ID NO: 46053 - RNA, 19 nt, Homo sapiens
gaccuuccaaccuccccca

SEQ ID NO: 46054 - RNA, 18 nt, Homo sapiens
acuuagugugugcagaga

SEQ ID NO: 46055 - RNA, 21 nt, Homo sapiens
accauauuucuccccacucug

SEQ ID NO: 46056 - RNA, 21 nt, Homo sapiens
auguggagcagggccacguga

SEQ ID NO: 46057 - RNA, 23 nt, Homo sapiens
caaacagaccuccugcccaucca

SEQ ID NO: 46058 - RNA, 18 nt, Homo sapiens
gcagcacagggcugcauc

SEQ ID NO: 46059 - RNA, 17 nt, Homo sapiens
gcccagaguccguccag

SEQ ID NO: 46060 - RNA, 23 nt, Homo sapiens
uccugauggcuaaugccucugag

SEQ ID NO: 46061 - RNA, 24 nt, Homo sapiens
ugagcacugacccacagcacuaca

SEQ ID NO: 46062 - RNA, 18 nt, Homo sapiens
uuccuagugaccauccag

SEQ ID NO: 46063 - RNA, 20 nt, Homo sapiens
uuuccaugucacagcuccac

SEQ ID NO: 46064 - RNA, 21 nt, Homo sapiens
ugggugggccuguccuggggc

SEQ ID NO: 46065 - RNA, 25 nt, Homo sapiens
ccuccagacccuaucaacagccuca

SEQ ID NO: 46066 - RNA, 19 nt, Homo sapiens
ucugaccuggaacagcagu

SEQ ID NO: 46067 - RNA, 21 nt, Homo sapiens
aucaaagucuugggcaucgug

SEQ ID NO: 46068 - RNA, 18 nt, Homo sapiens
gcagcgagagaacauauc

SEQ ID NO: 46069 - RNA, 20 nt, Homo sapiens
agacaacagauuauaagcua

SEQ ID NO: 46070 - RNA, 18 nt, Homo sapiens
cggcaagcagccccugga

SEQ ID NO: 46071 - RNA, 20 nt, Homo sapiens
aagccgacccaucuccccuc

SEQ ID NO: 46072 - RNA, 22 nt, Homo sapiens
cagcucugaauuaccaacgcug

SEQ ID NO: 46073 - RNA, 17 nt, Homo sapiens
gaaaacaugccggaagc

SEQ ID NO: 46074 - RNA, 22 nt, Homo sapiens
uuucaaaaaggucuccgacucc

SEQ ID NO: 46075 - RNA, 21 nt, Homo sapiens
ugcccagaacuuaggccucca

SEQ ID NO: 46076 - RNA, 24 nt, Homo sapiens
ugagaaagauggcuacacacaccu

SEQ ID NO: 46077 - RNA, 19 nt, Homo sapiens
caccuucuucagagacuca

SEQ ID NO: 46078 - RNA, 19 nt, Homo sapiens
ugaggcuauaucugcacuu

SEQ ID NO: 46079 - RNA, 24 nt, Homo sapiens
aaugcugcaacuuuuuuacaccua

SEQ ID NO: 46080 - RNA, 24 nt, Homo sapiens
uuguacuuuacuacuacagcauua

SEQ ID NO: 46081 - RNA, 19 nt, Homo sapiens
aaaaccaggcgcaaacaaa

SEQ ID NO: 46082 - RNA, 19 nt, Homo sapiens
cggcuucgaaagcuucgca

SEQ ID NO: 46083 - RNA, 18 nt, Homo sapiens
ccugguugggcggcccug

SEQ ID NO: 46084 - RNA, 19 nt, Homo sapiens
gccuaggcaucuucuuaua

SEQ ID NO: 46085 - RNA, 20 nt, Homo sapiens
caccucccuucccuuuuuua

SEQ ID NO: 46086 - RNA, 21 nt, Homo sapiens
caccucccuuccuuuuuuuca

SEQ ID NO: 46087 - RNA, 23 nt, Homo sapiens
ggcgugagccaccgcgcccggcc

SEQ ID NO: 46088 - RNA, 27 nt, Homo sapiens
ucugggcaguaaaccuagcucauuuuu

SEQ ID NO: 46089 - RNA, 19 nt, Homo sapiens
ugccauuuugauaaugcua

SEQ ID NO: 46090 - RNA, 21 nt, Homo sapiens
uuugacccgugggacuugugg

SEQ ID NO: 46091 - RNA, 21 nt, Homo sapiens
agccccagcugcuccuccuca

SEQ ID NO: 46092 - RNA, 22 nt, Homo sapiens
agcucauguccaccgagccucu

SEQ ID NO: 46093 - RNA, 20 nt, Homo sapiens
agggcgagcagaaggcuugc

SEQ ID NO: 46094 - RNA, 24 nt, Homo sapiens
caagaagauggaggagguggaagc

SEQ ID NO: 46095 - RNA, 23 nt, Homo sapiens
cacguaggcucagguggcugcag

SEQ ID NO: 46096 - RNA, 21 nt, Homo sapiens
uccaucacagugagcucccug

SEQ ID NO: 46097 - RNA, 19 nt, Homo sapiens
acugguggcaggcuguggc

SEQ ID NO: 46098 - RNA, 18 nt, Homo sapiens
gccucagccgccucacuc

SEQ ID NO: 46099 - RNA, 20 nt, Homo sapiens
gugggcagcacccugaacaa

SEQ ID NO: 46100 - RNA, 20 nt, Homo sapiens
augaggagacccugaacaca

SEQ ID NO: 46101 - RNA, 18 nt, Homo sapiens
aaccuuuugaauacaaug

SEQ ID NO: 46102 - RNA, 20 nt, Homo sapiens
accucauuaaacaucagaga

SEQ ID NO: 46103 - RNA, 21 nt, Homo sapiens
aucagagaacacacgugggga

SEQ ID NO: 46104 - RNA, 24 nt, Homo sapiens
ccuuacuaaacaucuaagaacaca

SEQ ID NO: 46105 - RNA, 21 nt, Homo sapiens
cuaugauaaugauucuucugg

SEQ ID NO: 46106 - RNA, 25 nt, Homo sapiens
cuugauuuuugcucgaauugcuuuu

SEQ ID NO: 46107 - RNA, 21 nt, Homo sapiens
gcuuaagaaaagaucauuaca

SEQ ID NO: 46108 - RNA, 19 nt, Homo sapiens
ccgcaggguaaccuugucu

SEQ ID NO: 46109 - RNA, 22 nt, Homo sapiens
cuccaaauuccuccucugcguc

SEQ ID NO: 46110 - RNA, 20 nt, Homo sapiens
uggugccauugccucagcca

SEQ ID NO: 46111 - RNA, 19 nt, Homo sapiens
ccgcaggguaaccuugucu

SEQ ID NO: 46112 - RNA, 22 nt, Homo sapiens
cuccaaauuccuccucugcguc

SEQ ID NO: 46113 - RNA, 19 nt, Homo sapiens
agaucugaagauacgcccc

SEQ ID NO: 46114 - RNA, 17 nt, Homo sapiens
gaauucaacacaacacg

SEQ ID NO: 46115 - RNA, 19 nt, Homo sapiens
acuucagacacacaccaca

SEQ ID NO: 46116 - RNA, 22 nt, Homo sapiens
acuuccggguuggccuucucca

SEQ ID NO: 46117 - RNA, 21 nt, Homo sapiens
agauggagauucagaaacaua

SEQ ID NO: 46118 - RNA, 18 nt, Homo sapiens
cuugaugcugcuugggcc

SEQ ID NO: 46119 - RNA, 19 nt, Homo sapiens
ggacaacaagaaacuuccc

SEQ ID NO: 46120 - RNA, 24 nt, Homo sapiens
ugcagggcugcgggcgcuugguuc

SEQ ID NO: 46121 - RNA, 22 nt, Homo sapiens
gcugcauuggaauuguguguug

SEQ ID NO: 46122 - RNA, 21 nt, Homo sapiens
uccagugggugacuggcccag

SEQ ID NO: 46123 - RNA, 16 nt, Homo sapiens
uguugguguaucugaa

SEQ ID NO: 46124 - RNA, 18 nt, Homo sapiens
accaccaccugcuugcuc

SEQ ID NO: 46125 - RNA, 21 nt, Homo sapiens
cuuguuaaccaaguuacuuuu

SEQ ID NO: 46126 - RNA, 23 nt, Homo sapiens
accaucgccaccccaguaaucac

SEQ ID NO: 46127 - RNA, 19 nt, Homo sapiens
cuccuggacucaagugauc

SEQ ID NO: 46128 - RNA, 19 nt, Homo sapiens
gaaccaggagaauugcuug

SEQ ID NO: 46129 - RNA, 21 nt, Homo sapiens
uccaauuuacuccucaugaca

SEQ ID NO: 46130 - RNA, 19 nt, Homo sapiens
uucucuacuaaaaauacaa

SEQ ID NO: 46131 - RNA, 21 nt, Homo sapiens
augcccaggucugccuacucc

SEQ ID NO: 46132 - RNA, 16 nt, Homo sapiens
caauugcagaaacauu

SEQ ID NO: 46133 - RNA, 18 nt, Homo sapiens
cagugcucucugguuugc

SEQ ID NO: 46134 - RNA, 16 nt, Homo sapiens
caucugucauaugagg

SEQ ID NO: 46135 - RNA, 21 nt, Homo sapiens
cuggcacuacucagcgugcua

SEQ ID NO: 46136 - RNA, 20 nt, Homo sapiens
gcugaggucuccucugccuc

SEQ ID NO: 46137 - RNA, 20 nt, Homo sapiens
ucuccccccaggaucaggga

SEQ ID NO: 46138 - RNA, 20 nt, Homo sapiens
ugcccaggucugccuacucc

SEQ ID NO: 46139 - RNA, 23 nt, Homo sapiens
uucugucucccaugucccugcga

SEQ ID NO: 46140 - RNA, 19 nt, Homo sapiens
ccaaaccccaaggcccuca

SEQ ID NO: 46141 - RNA, 17 nt, Homo sapiens
ggcccucaucugccuuu

SEQ ID NO: 46142 - RNA, 18 nt, Homo sapiens
gcagaguaucugcaggug

SEQ ID NO: 46143 - RNA, 23 nt, Homo sapiens
ucacuuugaccaugcuacgucac

SEQ ID NO: 46144 - RNA, 17 nt, Homo sapiens
gcaaccucagccaauga

SEQ ID NO: 46145 - RNA, 23 nt, Homo sapiens
acggagucugcccaggccacacc

SEQ ID NO: 46146 - RNA, 16 nt, Homo sapiens
accagagauuguaaua

SEQ ID NO: 46147 - RNA, 19 nt, Homo sapiens
cuugccuucuaggucacuu

SEQ ID NO: 46148 - RNA, 19 nt, Homo sapiens
gagauaaagagcagcuggg

SEQ ID NO: 46149 - RNA, 17 nt, Homo sapiens
ugugaacaccaacuucu

SEQ ID NO: 46150 - RNA, 23 nt, Homo sapiens
cagcauaaagcaaauguaacccu

SEQ ID NO: 46151 - RNA, 20 nt, Homo sapiens
ccaugcucuacagcacuuca

SEQ ID NO: 46152 - RNA, 23 nt, Homo sapiens
accccacucccggccugacacca

SEQ ID NO: 46153 - RNA, 24 nt, Homo sapiens
caagcaucaugguuuccccagugg

SEQ ID NO: 46154 - RNA, 21 nt, Homo sapiens
cagagcuaauuaaacauuuca

SEQ ID NO: 46155 - RNA, 19 nt, Homo sapiens
uaugguaacaacaauaaau

SEQ ID NO: 46156 - RNA, 19 nt, Homo sapiens
uauuuuuuuacuucuugca

SEQ ID NO: 46157 - RNA, 19 nt, Homo sapiens
uuccugugccagugcugaa

SEQ ID NO: 46158 - RNA, 24 nt, Homo sapiens
ccccuuggucacaugaaccaggga

SEQ ID NO: 46159 - RNA, 19 nt, Homo sapiens
gacuucuaguguggaagug

SEQ ID NO: 46160 - RNA, 17 nt, Homo sapiens
gagugcaagcauggaac

SEQ ID NO: 46161 - RNA, 22 nt, Homo sapiens
cacuguaccacagccugagcaa

SEQ ID NO: 46162 - RNA, 16 nt, Homo sapiens
ucccagcaggcugcaa

SEQ ID NO: 46163 - RNA, 19 nt, Homo sapiens
aggaaagagaaaugucacc

SEQ ID NO: 46164 - RNA, 17 nt, Homo sapiens
cagcuuucaaaucuucc

SEQ ID NO: 46165 - RNA, 22 nt, Homo sapiens
ucaugaaaugcaaaacaauagg

SEQ ID NO: 46166 - RNA, 21 nt, Homo sapiens
uccaauacaaugccucuucuc

SEQ ID NO: 46167 - RNA, 18 nt, Homo sapiens
uggaagagaggguucuga

SEQ ID NO: 46168 - RNA, 20 nt, Homo sapiens
uuuuaggaaugaaggugucu

SEQ ID NO: 46169 - RNA, 23 nt, Homo sapiens
auagcauaggcagccugacucca

SEQ ID NO: 46170 - RNA, 16 nt, Homo sapiens
gcccuauuuuacagcu

SEQ ID NO: 46171 - RNA, 17 nt, Homo sapiens
ucaaacauuaaaaugug

SEQ ID NO: 46172 - RNA, 17 nt, Homo sapiens
ucaucugcaauauuugg

SEQ ID NO: 46173 - RNA, 24 nt, Homo sapiens
auucugaugauuacucagaacucu

SEQ ID NO: 46174 - RNA, 18 nt, Homo sapiens
gugaagacaggugcucgc

SEQ ID NO: 46175 - RNA, 19 nt, Homo sapiens
cugcaagcuccgccuccca

SEQ ID NO: 46176 - RNA, 18 nt, Homo sapiens
uccgccucccagguucaa

SEQ ID NO: 46177 - RNA, 20 nt, Homo sapiens
aagaugcacuaagauguggu

SEQ ID NO: 46178 - RNA, 18 nt, Homo sapiens
aguaccaauuucaaucca

SEQ ID NO: 46179 - RNA, 18 nt, Homo sapiens
ggcacaagcucuggccca

SEQ ID NO: 46180 - RNA, 19 nt, Homo sapiens
uauccuucucgaguuccca

SEQ ID NO: 46181 - RNA, 19 nt, Homo sapiens
uucucuacuaaaaaugcaa

SEQ ID NO: 46182 - RNA, 19 nt, Homo sapiens
uucuuacccaacacaucaa

SEQ ID NO: 46183 - RNA, 22 nt, Homo sapiens
cagcaucaccaacggugaagaa

SEQ ID NO: 46184 - RNA, 21 nt, Homo sapiens
gcccuucacaaacugcggccu

SEQ ID NO: 46185 - RNA, 18 nt, Homo sapiens
ggcuuggcccagccucca

SEQ ID NO: 46186 - RNA, 21 nt, Homo sapiens
ugcccagaacagguggcccag

SEQ ID NO: 46187 - RNA, 21 nt, Homo sapiens
uucacaaacugcggccuggca

SEQ ID NO: 46188 - RNA, 20 nt, Homo sapiens
uuuuauacacagagccauua

SEQ ID NO: 46189 - RNA, 18 nt, Homo sapiens
auagaaccuuugauuuuu

SEQ ID NO: 46190 - RNA, 16 nt, Homo sapiens
gcggccaacauuccag

SEQ ID NO: 46191 - RNA, 19 nt, Homo sapiens
gugcagguaugacuguguu

SEQ ID NO: 46192 - RNA, 20 nt, Homo sapiens
uggcauuccagcaggagcua

SEQ ID NO: 46193 - RNA, 19 nt, Homo sapiens
ccuauggcaugaugaacuu

SEQ ID NO: 46194 - RNA, 20 nt, Homo sapiens
gcuccagggacucuugggga

SEQ ID NO: 46195 - RNA, 23 nt, Homo sapiens
gaaagauaagacgcccccuuuca

SEQ ID NO: 46196 - RNA, 17 nt, Homo sapiens
gaacucgccagcagcua

SEQ ID NO: 46197 - RNA, 19 nt, Homo sapiens
gaacucgccagcagcuagc

SEQ ID NO: 46198 - RNA, 18 nt, Homo sapiens
gaucccuucugagcucac

SEQ ID NO: 46199 - RNA, 18 nt, Homo sapiens
ggcuuggcacccgccaaa

SEQ ID NO: 46200 - RNA, 19 nt, Homo sapiens
agaaaauucagaucagcaa

SEQ ID NO: 46201 - RNA, 18 nt, Homo sapiens
cccgcauccuccaccucc

SEQ ID NO: 46202 - RNA, 22 nt, Homo sapiens
uaaaugaauagugauguggagc

SEQ ID NO: 46203 - RNA, 18 nt, Homo sapiens
uccaccucccagguucaa

SEQ ID NO: 46204 - RNA, 20 nt, Homo sapiens
uugauacauuauuauaaacu

SEQ ID NO: 46205 - RNA, 16 nt, Homo sapiens
uugggugaaaugucug

SEQ ID NO: 46206 - RNA, 19 nt, Homo sapiens
cgaaucugugacugccucu

SEQ ID NO: 46207 - RNA, 19 nt, Homo sapiens
acuuggauugcauuuggcu

SEQ ID NO: 46208 - RNA, 20 nt, Homo sapiens
cccagagcuuggcguuucag

SEQ ID NO: 46209 - RNA, 18 nt, Homo sapiens
cugaaaacccucugaugc

SEQ ID NO: 46210 - RNA, 23 nt, Homo sapiens
cuucucccguccuccccuccccu

SEQ ID NO: 46211 - RNA, 19 nt, Homo sapiens
gccaugggaagggcccagg

SEQ ID NO: 46212 - RNA, 22 nt, Homo sapiens
ggaggaggagggggaccagcca

SEQ ID NO: 46213 - RNA, 19 nt, Homo sapiens
ucaauagggaugaugacgg

SEQ ID NO: 46214 - RNA, 21 nt, Homo sapiens
uccuccccuccccuucccuug

SEQ ID NO: 46215 - RNA, 18 nt, Homo sapiens
ucuuuucuguguuuuaac

SEQ ID NO: 46216 - RNA, 15 nt, Homo sapiens
uguugaguacagacc

SEQ ID NO: 46217 - RNA, 18 nt, Homo sapiens
cccccgacgcccuccccg

SEQ ID NO: 46218 - RNA, 19 nt, Homo sapiens
gccagccucucgggaguca

SEQ ID NO: 46219 - RNA, 24 nt, Homo sapiens
ucagcccugcgguccugccgcgca

SEQ ID NO: 46220 - RNA, 19 nt, Homo sapiens
cuugcccagaacuacuucu

SEQ ID NO: 46221 - RNA, 22 nt, Homo sapiens
gccuccucacugucuaccucca

SEQ ID NO: 46222 - RNA, 23 nt, Homo sapiens
gcuuggaguugcuguccuggccc

SEQ ID NO: 46223 - RNA, 18 nt, Homo sapiens
ggugggaacccccuucca

SEQ ID NO: 46224 - RNA, 19 nt, Homo sapiens
agcuguggguacccgggag

SEQ ID NO: 46225 - RNA, 16 nt, Homo sapiens
ccacagcugcgccugg

SEQ ID NO: 46226 - RNA, 20 nt, Homo sapiens
gggcccuccccugcugccac

SEQ ID NO: 46227 - RNA, 22 nt, Homo sapiens
accccuucucuccuaccucuga

SEQ ID NO: 46228 - RNA, 21 nt, Homo sapiens
aucaaugugauucauugaugu

SEQ ID NO: 46229 - RNA, 23 nt, Homo sapiens
aucauuuaucauguucacagauu

SEQ ID NO: 46230 - RNA, 22 nt, Homo sapiens
ucagggcgcacguguuuguuca

SEQ ID NO: 46231 - RNA, 23 nt, Homo sapiens
uuguaaggaucaugggaaaucua

SEQ ID NO: 46232 - RNA, 20 nt, Homo sapiens
uggccaggcuggucuugaac

SEQ ID NO: 46233 - RNA, 19 nt, Homo sapiens
aagcaauucuccugccuca

SEQ ID NO: 46234 - RNA, 22 nt, Homo sapiens
auguacucacacugcucuuccu

SEQ ID NO: 46235 - RNA, 17 nt, Homo sapiens
caccaggccccguugca

SEQ ID NO: 46236 - RNA, 18 nt, Homo sapiens
ccugcaaccuccaccucc

SEQ ID NO: 46237 - RNA, 19 nt, Homo sapiens
uaggguuauguuuucaguu

SEQ ID NO: 46238 - RNA, 22 nt, Homo sapiens
ucugccuggcagccuagccuca

SEQ ID NO: 46239 - RNA, 22 nt, Homo sapiens
ucuugguggcaucaagcuugug

SEQ ID NO: 46240 - RNA, 20 nt, Homo sapiens
uggccaggcuggucuugaac

SEQ ID NO: 46241 - RNA, 18 nt, Homo sapiens
caacaggagagccacuuu

SEQ ID NO: 46242 - RNA, 18 nt, Homo sapiens
ccuugggguuuugaucag

SEQ ID NO: 46243 - RNA, 19 nt, Homo sapiens
cugagucugggucuggguc

SEQ ID NO: 46244 - RNA, 17 nt, Homo sapiens
cuguuuugcuccauccc

SEQ ID NO: 46245 - RNA, 21 nt, Homo sapiens
gcuugggucugagucuggguc

SEQ ID NO: 46246 - RNA, 19 nt, Homo sapiens
ggacagggaaagggccacc

SEQ ID NO: 46247 - RNA, 24 nt, Homo sapiens
ugaaugugagccgauaugcagcug

SEQ ID NO: 46248 - RNA, 17 nt, Homo sapiens
cccaggagcccgcccag

SEQ ID NO: 46249 - RNA, 18 nt, Homo sapiens
acaccgcacugccaauau

SEQ ID NO: 46250 - RNA, 22 nt, Homo sapiens
augcucagaaucuaauauucaa

SEQ ID NO: 46251 - RNA, 18 nt, Homo sapiens
caggugcagccuccuuca

SEQ ID NO: 46252 - RNA, 19 nt, Homo sapiens
guuauggaaauacagauua

SEQ ID NO: 46253 - RNA, 17 nt, Homo sapiens
uauuaaauguguuguua

SEQ ID NO: 46254 - RNA, 19 nt, Homo sapiens
uccuuuagauccaaucgga

SEQ ID NO: 46255 - RNA, 18 nt, Homo sapiens
gaauuuuugaauucugga

SEQ ID NO: 46256 - RNA, 18 nt, Homo sapiens
uauccuaagccuccugga

SEQ ID NO: 46257 - RNA, 18 nt, Homo sapiens
uggguggaucaccugagg

SEQ ID NO: 46258 - RNA, 18 nt, Homo sapiens
uugcaggaggccaagcuc

SEQ ID NO: 46259 - RNA, 16 nt, Homo sapiens
cucccucccugucucu

SEQ ID NO: 46260 - RNA, 22 nt, Homo sapiens
cuggcuaagcggucuuaagcac

SEQ ID NO: 46261 - RNA, 18 nt, Homo sapiens
ggccaagacaacaacauc

SEQ ID NO: 46262 - RNA, 18 nt, Homo sapiens
aagguguuacaaagagca

SEQ ID NO: 46263 - RNA, 22 nt, Homo sapiens
cauuuccggugggcucugggga

SEQ ID NO: 46264 - RNA, 20 nt, Homo sapiens
gcucacacucuccucucaca

SEQ ID NO: 46265 - RNA, 19 nt, Homo sapiens
ggcuucugcagucauguuu

SEQ ID NO: 46266 - RNA, 17 nt, Homo sapiens
ucaccaauaucauugga

SEQ ID NO: 46267 - RNA, 21 nt, Homo sapiens
ucucaccauauguaccaaaga

SEQ ID NO: 46268 - RNA, 17 nt, Homo sapiens
ugcucccagagacacug

SEQ ID NO: 46269 - RNA, 21 nt, Homo sapiens
uugcagaugcuacccucauac

SEQ ID NO: 46270 - RNA, 18 nt, Homo sapiens
gugucaggcucauuccca

SEQ ID NO: 46271 - RNA, 21 nt, Homo sapiens
aggcaccugugcccacccccu

SEQ ID NO: 46272 - RNA, 17 nt, Homo sapiens
ccauuuccacccccaaa

SEQ ID NO: 46273 - RNA, 18 nt, Homo sapiens
cccccaaauaccucccca

SEQ ID NO: 46274 - RNA, 24 nt, Homo sapiens
cuccaacugugccccauuuccacc

SEQ ID NO: 46275 - RNA, 23 nt, Homo sapiens
aucagccaagcaggcugcugaga

SEQ ID NO: 46276 - RNA, 18 nt, Homo sapiens
auggagucucccucuguc

SEQ ID NO: 46277 - RNA, 26 nt, Homo sapiens
ucauccuccuaaauuucacugucuua

SEQ ID NO: 46278 - RNA, 18 nt, Homo sapiens
ucugcccaccucugccuc

SEQ ID NO: 46279 - RNA, 21 nt, Homo sapiens
caggacaccagcuggguccag

SEQ ID NO: 46280 - RNA, 17 nt, Homo sapiens
ccgcccaccgccacuau

SEQ ID NO: 46281 - RNA, 19 nt, Homo sapiens
cugcucccacaccugcgcc

SEQ ID NO: 46282 - RNA, 19 nt, Homo sapiens
ggcuucuguggacgacuca

SEQ ID NO: 46283 - RNA, 22 nt, Homo sapiens
ugccuccccucugcccaucucu

SEQ ID NO: 46284 - RNA, 17 nt, Homo sapiens
ugcucccacaccugcgc

SEQ ID NO: 46285 - RNA, 19 nt, Homo sapiens
aacccagcccugcacacca

SEQ ID NO: 46286 - RNA, 18 nt, Homo sapiens
acaacaagcuccucacca

SEQ ID NO: 46287 - RNA, 21 nt, Homo sapiens
agcuggguuacuuugaccuca

SEQ ID NO: 46288 - RNA, 21 nt, Homo sapiens
ccucggcggccacuugaccaa

SEQ ID NO: 46289 - RNA, 22 nt, Homo sapiens
acuugagauuuccugaagcgca

SEQ ID NO: 46290 - RNA, 20 nt, Homo sapiens
aucugcaucucagccugaga

SEQ ID NO: 46291 - RNA, 17 nt, Homo sapiens
caaaaacgcugacaugc

SEQ ID NO: 46292 - RNA, 18 nt, Homo sapiens
guggggggccgagugcug

SEQ ID NO: 46293 - RNA, 19 nt, Homo sapiens
ucaaaaacgcugacaugca

SEQ ID NO: 46294 - RNA, 23 nt, Homo sapiens
gucucugaggccucauccaguuc

SEQ ID NO: 46295 - RNA, 21 nt, Homo sapiens
auguauuuugugaguuucucc

SEQ ID NO: 46296 - RNA, 18 nt, Homo sapiens
cauccauuccugagcuca

SEQ ID NO: 46297 - RNA, 19 nt, Homo sapiens
gagauuucaaggcucagca

SEQ ID NO: 46298 - RNA, 25 nt, Homo sapiens
ugaauguggcuaccuaauguggaac

SEQ ID NO: 46299 - RNA, 19 nt, Homo sapiens
ccaagucccacucucugga

SEQ ID NO: 46300 - RNA, 26 nt, Homo sapiens
acccaggagggaugacggagcugcca

SEQ ID NO: 46301 - RNA, 16 nt, Homo sapiens
agcaaacaaaaucaug

SEQ ID NO: 46302 - RNA, 23 nt, Homo sapiens
ggcagcaaacaaaaucaugcaca

SEQ ID NO: 46303 - RNA, 22 nt, Homo sapiens
ucccagguuccaagcucugggc

SEQ ID NO: 46304 - RNA, 23 nt, Homo sapiens
cacuccaguguucccagccccaa

SEQ ID NO: 46305 - RNA, 22 nt, Homo sapiens
cuccuucucucugucuaccuca

SEQ ID NO: 46306 - RNA, 22 nt, Homo sapiens
ccaccagucccagaacccgcca

SEQ ID NO: 46307 - RNA, 25 nt, Homo sapiens
cccuggggaugggguggucugugaa

SEQ ID NO: 46308 - RNA, 20 nt, Homo sapiens
ucaacagcacacucagugca

SEQ ID NO: 46309 - RNA, 27 nt, Homo sapiens
gaccccuaagaguucaagccaugcugg

SEQ ID NO: 46310 - RNA, 19 nt, Homo sapiens
caccacucacccauucuuu

SEQ ID NO: 46311 - RNA, 18 nt, Homo sapiens
cucuuguccuccugccuc

SEQ ID NO: 46312 - RNA, 23 nt, Homo sapiens
aucuaccaaaacaagaucugcca

SEQ ID NO: 46313 - RNA, 18 nt, Homo sapiens
ggcuaauagcacuucucc

SEQ ID NO: 46314 - RNA, 19 nt, Homo sapiens
ccuucagagaagcagacca

SEQ ID NO: 46315 - RNA, 26 nt, Homo sapiens
ccuccccagccuccagcuccucucca

SEQ ID NO: 46316 - RNA, 17 nt, Homo sapiens
uuucaugugaaaucauc

SEQ ID NO: 46317 - RNA, 18 nt, Homo sapiens
agcuaccucccuucugug

SEQ ID NO: 46318 - RNA, 22 nt, Homo sapiens
cagaaaaacugcugaauucugg

SEQ ID NO: 46319 - RNA, 19 nt, Homo sapiens
cgccgaguccgcgagcucu

SEQ ID NO: 46320 - RNA, 18 nt, Homo sapiens
gauccuagcgcggagcug

SEQ ID NO: 46321 - RNA, 24 nt, Homo sapiens
gcgaggagaggcagcacugcugcu

SEQ ID NO: 46322 - RNA, 19 nt, Homo sapiens
gauggacuuaacugugaaa

SEQ ID NO: 46323 - RNA, 19 nt, Homo sapiens
auagacauacagagauaua

SEQ ID NO: 46324 - RNA, 18 nt, Homo sapiens
ccugaaccagccuggucc

SEQ ID NO: 46325 - RNA, 21 nt, Homo sapiens
gacaaucuauuucuugagcca

SEQ ID NO: 46326 - RNA, 20 nt, Homo sapiens
aacuagcuaacuuuguacuu

SEQ ID NO: 46327 - RNA, 19 nt, Homo sapiens
aacuucuguuuaaagaugc

SEQ ID NO: 46328 - RNA, 18 nt, Homo sapiens
aaugcaguaggcaaaugu

SEQ ID NO: 46329 - RNA, 21 nt, Homo sapiens
agaggagaugaaucauguugc

SEQ ID NO: 46330 - RNA, 21 nt, Homo sapiens
auauggcucaaggacugccgg

SEQ ID NO: 46331 - RNA, 26 nt, Homo sapiens
gaaucacacuauaguuuaaugacaua

SEQ ID NO: 46332 - RNA, 19 nt, Homo sapiens
uaaaugggcuuuaauuuug

SEQ ID NO: 46333 - RNA, 25 nt, Homo sapiens
uuguucaaauauuagaguuagggua

SEQ ID NO: 46334 - RNA, 17 nt, Homo sapiens
auguugacaucgacuuu

SEQ ID NO: 46335 - RNA, 20 nt, Homo sapiens
cucugaaccagaagucauca

SEQ ID NO: 46336 - RNA, 17 nt, Homo sapiens
gcccaguggcuuuaaac

SEQ ID NO: 46337 - RNA, 18 nt, Homo sapiens
ggaccuaaaacagugucu

SEQ ID NO: 46338 - RNA, 19 nt, Homo sapiens
ugcaaggugcugccuaacu

SEQ ID NO: 46339 - RNA, 18 nt, Homo sapiens
gccugagucccaggaguc

SEQ ID NO: 46340 - RNA, 20 nt, Homo sapiens
ugacugcacaaaucagcuca

SEQ ID NO: 46341 - RNA, 18 nt, Homo sapiens
acacaggaggcggugcug

SEQ ID NO: 46342 - RNA, 18 nt, Homo sapiens
cccccgucacccccuccc

SEQ ID NO: 46343 - RNA, 24 nt, Homo sapiens
cgagcggaagcuucccgcccggcc

SEQ ID NO: 46344 - RNA, 20 nt, Homo sapiens
cgcgggcuccccgugcccgu

SEQ ID NO: 46345 - RNA, 26 nt, Homo sapiens
cucccccucuagaauaccaggauccu

SEQ ID NO: 46346 - RNA, 19 nt, Homo sapiens
cucuagaauaccaggaucc

SEQ ID NO: 46347 - RNA, 23 nt, Homo sapiens
gccgcgggcucaggcugaggccu

SEQ ID NO: 46348 - RNA, 23 nt, Homo sapiens
gcuccccuguccccugcucuucu

SEQ ID NO: 46349 - RNA, 22 nt, Homo sapiens
gcucugagaauuagcuucacuu

SEQ ID NO: 46350 - RNA, 22 nt, Homo sapiens
ucucugccguggaagggacuca

SEQ ID NO: 46351 - RNA, 19 nt, Homo sapiens
uggccgcugggcugugaac

SEQ ID NO: 46352 - RNA, 22 nt, Homo sapiens
uguuaauccauuuuuuacauuu

SEQ ID NO: 46353 - RNA, 20 nt, Homo sapiens
cccagcccacuccuguucca

SEQ ID NO: 46354 - RNA, 18 nt, Homo sapiens
gcgcuaggagggguccgg

SEQ ID NO: 46355 - RNA, 22 nt, Homo sapiens
ggccaaucaggcgcgagcaccu

SEQ ID NO: 46356 - RNA, 23 nt, Homo sapiens
auugaaguaggcucaaacccuca

SEQ ID NO: 46357 - RNA, 24 nt, Homo sapiens
acaauuuuuaaauaaaggauacca

SEQ ID NO: 46358 - RNA, 21 nt, Homo sapiens
gcagcuucagacauuugguua

SEQ ID NO: 46359 - RNA, 27 nt, Homo sapiens
aggaaagaaaaaaaggaaaggaaccuu

SEQ ID NO: 46360 - RNA, 24 nt, Homo sapiens
cucuuuggguuagugugguaugua

SEQ ID NO: 46361 - RNA, 18 nt, Homo sapiens
guggauuggugccagaga

SEQ ID NO: 46362 - RNA, 17 nt, Homo sapiens
gaauaaaaagaagauuc

SEQ ID NO: 46363 - RNA, 17 nt, Homo sapiens
gacucaacaaacaucca

SEQ ID NO: 46364 - RNA, 17 nt, Homo sapiens
ucuuguuccuuaacuuu

SEQ ID NO: 46365 - RNA, 18 nt, Homo sapiens
aucguccauccuacaggu

SEQ ID NO: 46366 - RNA, 20 nt, Homo sapiens
ucuacaagguguuguggcca

SEQ ID NO: 46367 - RNA, 22 nt, Homo sapiens
caggaugugaaaagauugccuc

SEQ ID NO: 46368 - RNA, 21 nt, Homo sapiens
ccuaggggccugaucauuuuu

SEQ ID NO: 46369 - RNA, 17 nt, Homo sapiens
ugcuauaggaugcuaua

SEQ ID NO: 46370 - RNA, 23 nt, Homo sapiens
ugggaugacggaagaccugggga

SEQ ID NO: 46371 - RNA, 17 nt, Homo sapiens
acaacauacuaggcacu

SEQ ID NO: 46372 - RNA, 22 nt, Homo sapiens
accagaaggaagaaacucugaa

SEQ ID NO: 46373 - RNA, 22 nt, Homo sapiens
acucaccgcgaggguccgcggc

SEQ ID NO: 46374 - RNA, 17 nt, Homo sapiens
gccacaccucagccucc

SEQ ID NO: 46375 - RNA, 22 nt, Homo sapiens
ggcuuagcaacacugcucacca

SEQ ID NO: 46376 - RNA, 19 nt, Homo sapiens
aaacacauaucaagaucca

SEQ ID NO: 46377 - RNA, 17 nt, Homo sapiens
gcaaccucagccaauga

SEQ ID NO: 46378 - RNA, 19 nt, Homo sapiens
acugguggcaggcuguggc

SEQ ID NO: 46379 - RNA, 16 nt, Homo sapiens
ccacuccacauucucu

SEQ ID NO: 46380 - RNA, 20 nt, Homo sapiens
gcccgaggcaaugaacagua

SEQ ID NO: 46381 - RNA, 21 nt, Homo sapiens
ggccucaauguucucauuuua

SEQ ID NO: 46382 - RNA, 16 nt, Homo sapiens
ucgaugucccugacuu

SEQ ID NO: 46383 - RNA, 23 nt, Homo sapiens
ucuguucuaaacagauugugcaa

SEQ ID NO: 46384 - RNA, 17 nt, Homo sapiens
aggagcgcaguuaccag

SEQ ID NO: 46385 - RNA, 20 nt, Homo sapiens
acucaaggaggcuggguuuc

SEQ ID NO: 46386 - RNA, 20 nt, Homo sapiens
uuuuauuuugccaucaguua

SEQ ID NO: 46387 - RNA, 21 nt, Homo sapiens
agcugaacgccugcuuagcuu

SEQ ID NO: 46388 - RNA, 22 nt, Homo sapiens
ccugccuucucguauugcugcu

SEQ ID NO: 46389 - RNA, 20 nt, Homo sapiens
uagauggaccccaaaacuga

SEQ ID NO: 46390 - RNA, 20 nt, Homo sapiens
uccugaaccucaaaucaaca

SEQ ID NO: 46391 - RNA, 21 nt, Homo sapiens
ugucucuccugccuucugcuu

SEQ ID NO: 46392 - RNA, 18 nt, Homo sapiens
acccaaaaagguaaguuu

SEQ ID NO: 46393 - RNA, 17 nt, Homo sapiens
gaaucugcaucugagaa

SEQ ID NO: 46394 - RNA, 19 nt, Homo sapiens
uacuuaguaacucacuuuu

SEQ ID NO: 46395 - RNA, 17 nt, Homo sapiens
aaugcuuaguuaacaag

SEQ ID NO: 46396 - RNA, 18 nt, Homo sapiens
acaacuccacucugugac

SEQ ID NO: 46397 - RNA, 24 nt, Homo sapiens
agaauagcuacaaacaacugguca

SEQ ID NO: 46398 - RNA, 24 nt, Homo sapiens
agagaguaccugacuucagaccac

SEQ ID NO: 46399 - RNA, 20 nt, Homo sapiens
cacggggagucccauugcca

SEQ ID NO: 46400 - RNA, 23 nt, Homo sapiens
ccacugcuggggaaaaugugcca

SEQ ID NO: 46401 - RNA, 22 nt, Homo sapiens
gaaguuaaacuuuacaaaauga

SEQ ID NO: 46402 - RNA, 22 nt, Homo sapiens
gaauagcuacaaacaacugguc

SEQ ID NO: 46403 - RNA, 18 nt, Homo sapiens
gggccuccacauccucca

SEQ ID NO: 46404 - RNA, 20 nt, Homo sapiens
ugcccaagauuauucucuca

SEQ ID NO: 46405 - RNA, 21 nt, Homo sapiens
uggauucguaaggugaggcug

SEQ ID NO: 46406 - RNA, 18 nt, Homo sapiens
agaaaaacuuuggacaaa

SEQ ID NO: 46407 - RNA, 18 nt, Homo sapiens
ccuugaucuuggacuugc

SEQ ID NO: 46408 - RNA, 19 nt, Homo sapiens
uauaaaaagagacacaaga

SEQ ID NO: 46409 - RNA, 22 nt, Homo sapiens
ucuuuuucaacagaacuucaca

SEQ ID NO: 46410 - RNA, 16 nt, Homo sapiens
gacccacguggaacug

SEQ ID NO: 46411 - RNA, 18 nt, Homo sapiens
agaaacccucaucucuac

SEQ ID NO: 46412 - RNA, 20 nt, Homo sapiens
cgaagaaacccucaucucua

SEQ ID NO: 46413 - RNA, 22 nt, Homo sapiens
gagccaagauugugccacugca

SEQ ID NO: 46414 - RNA, 20 nt, Homo sapiens
uacaaccugggcaacagagc

SEQ ID NO: 46415 - RNA, 21 nt, Homo sapiens
ucccacuacugaucaguacug

SEQ ID NO: 46416 - RNA, 19 nt, Homo sapiens
uuuaggagacgugguaggu

SEQ ID NO: 46417 - RNA, 16 nt, Homo sapiens
ugcguacauauguggu

SEQ ID NO: 46418 - RNA, 19 nt, Homo sapiens
cacagcuggcucguggcug

SEQ ID NO: 46419 - RNA, 28 nt, Homo sapiens
ccaaaacaauauuacaaguuuaauauca

SEQ ID NO: 46420 - RNA, 20 nt, Homo sapiens
uaaugcuuucuaacaugaag

SEQ ID NO: 46421 - RNA, 18 nt, Homo sapiens
augaauguuaaaaaugaa

SEQ ID NO: 46422 - RNA, 18 nt, Homo sapiens
uucucuaucacucacaac

SEQ ID NO: 46423 - RNA, 25 nt, Homo sapiens
uugcaaccuccgcuuccuggauuca

SEQ ID NO: 46424 - RNA, 18 nt, Homo sapiens
gcccacggccuccaguca

SEQ ID NO: 46425 - RNA, 18 nt, Homo sapiens
acccaccuucucacuucc

SEQ ID NO: 46426 - RNA, 17 nt, Homo sapiens
gacccuggcugacugca

SEQ ID NO: 46427 - RNA, 17 nt, Homo sapiens
gcguaugugcccugggu

SEQ ID NO: 46428 - RNA, 21 nt, Homo sapiens
gguugccccucuacucagaga

SEQ ID NO: 46429 - RNA, 17 nt, Homo sapiens
ccuggucucuggcuguc

SEQ ID NO: 46430 - RNA, 18 nt, Homo sapiens
cgaucuuccggaagacac

SEQ ID NO: 46431 - RNA, 20 nt, Homo sapiens
gcaaacugugaagugcagug

SEQ ID NO: 46432 - RNA, 20 nt, Homo sapiens
ggaagagcuugggcgacaug

SEQ ID NO: 46433 - RNA, 22 nt, Homo sapiens
caagacaacaacaguggugggc

SEQ ID NO: 46434 - RNA, 24 nt, Homo sapiens
gccaaaguccccaguggcaaauca

SEQ ID NO: 46435 - RNA, 21 nt, Homo sapiens
ucaguucaaaacaacacauga

SEQ ID NO: 46436 - RNA, 21 nt, Homo sapiens
ggaggaggcaguauggcaaga

SEQ ID NO: 46437 - RNA, 20 nt, Homo sapiens
acaacagguacaaaguccua

SEQ ID NO: 46438 - RNA, 18 nt, Homo sapiens
acagagggcuccagacca

SEQ ID NO: 46439 - RNA, 18 nt, Homo sapiens
ccaaaaaacaaaaaaccc

SEQ ID NO: 46440 - RNA, 21 nt, Homo sapiens
aacacuagaaaaaagaaaugu

SEQ ID NO: 46441 - RNA, 22 nt, Homo sapiens
gaaauuugagcuaaacauuuuu

SEQ ID NO: 46442 - RNA, 20 nt, Homo sapiens
gcauuuuucuauuuucccca

SEQ ID NO: 46443 - RNA, 20 nt, Homo sapiens
uagauggauacugaauacuc

SEQ ID NO: 46444 - RNA, 21 nt, Homo sapiens
uggaaaaacuaguguuaggga

SEQ ID NO: 46445 - RNA, 25 nt, Homo sapiens
agggaagugauguugggucacuuuu

SEQ ID NO: 46446 - RNA, 19 nt, Homo sapiens
auacaacuuacccucauca

SEQ ID NO: 46447 - RNA, 20 nt, Homo sapiens
aucauggaggcagguauuuc

SEQ ID NO: 46448 - RNA, 21 nt, Homo sapiens
cagcaauguagaacuguaagu

SEQ ID NO: 46449 - RNA, 22 nt, Homo sapiens
cauguguugugggagggaccca

SEQ ID NO: 46450 - RNA, 21 nt, Homo sapiens
ccuuuuuacaguuuuugacuu

SEQ ID NO: 46451 - RNA, 23 nt, Homo sapiens
cugcagaagcucuaucuuugauu

SEQ ID NO: 46452 - RNA, 19 nt, Homo sapiens
cugcuuuugcuguauccca

SEQ ID NO: 46453 - RNA, 18 nt, Homo sapiens
gcaaugauuuugaagccu

SEQ ID NO: 46454 - RNA, 21 nt, Homo sapiens
ggcguuuccucaggccucuca

SEQ ID NO: 46455 - RNA, 24 nt, Homo sapiens
ggucugaugguuuugaaaagggua

SEQ ID NO: 46456 - RNA, 24 nt, Homo sapiens
gugucugaacuaccagugaguuuu

SEQ ID NO: 46457 - RNA, 20 nt, Homo sapiens
guucuuucacuucccaaugu

SEQ ID NO: 46458 - RNA, 19 nt, Homo sapiens
ucacugacagcuugcacug

SEQ ID NO: 46459 - RNA, 19 nt, Homo sapiens
uugucuuuugacaauuuua

SEQ ID NO: 46460 - RNA, 23 nt, Homo sapiens
uuuagcuacuccugauuauuuuu

SEQ ID NO: 46461 - RNA, 22 nt, Homo sapiens
aaaaucaggaacuaucauugga

SEQ ID NO: 46462 - RNA, 19 nt, Homo sapiens
acaaaaugacauucccuca

SEQ ID NO: 46463 - RNA, 18 nt, Homo sapiens
agagauugagacaaaaug

SEQ ID NO: 46464 - RNA, 21 nt, Homo sapiens
cacuccccgcagucccccuga

SEQ ID NO: 46465 - RNA, 19 nt, Homo sapiens
cucuccuuuggcuaaucug

SEQ ID NO: 46466 - RNA, 17 nt, Homo sapiens
ggaacuaucauuggaga

SEQ ID NO: 46467 - RNA, 22 nt, Homo sapiens
aaaaucaggaacuaucauugga

SEQ ID NO: 46468 - RNA, 19 nt, Homo sapiens
acaaaaugacauucccuca

SEQ ID NO: 46469 - RNA, 18 nt, Homo sapiens
agagauugagacaaaaug

SEQ ID NO: 46470 - RNA, 21 nt, Homo sapiens
cacuccccgcagucccccuga

SEQ ID NO: 46471 - RNA, 19 nt, Homo sapiens
cucuccuuuggcuaaucug

SEQ ID NO: 46472 - RNA, 17 nt, Homo sapiens
ggaacuaucauuggaga

SEQ ID NO: 46473 - RNA, 19 nt, Homo sapiens
aaacacauaucaagaucca

SEQ ID NO: 46474 - RNA, 19 nt, Homo sapiens
ccccagcaaccucagccaa

SEQ ID NO: 46475 - RNA, 17 nt, Homo sapiens
gcaaccucagccaauga

SEQ ID NO: 46476 - RNA, 17 nt, Homo sapiens
ccgcagacgccuugucu

SEQ ID NO: 46477 - RNA, 24 nt, Homo sapiens
uggguggacuccagccuccccagc

SEQ ID NO: 46478 - RNA, 19 nt, Homo sapiens
uucccauucuuguacaaua

SEQ ID NO: 46479 - RNA, 19 nt, Homo sapiens
aagagcaggaggccaggca

SEQ ID NO: 46480 - RNA, 19 nt, Homo sapiens
agacgaugaccacagcaua

SEQ ID NO: 46481 - RNA, 20 nt, Homo sapiens
ggccacguuccaacaaguga

SEQ ID NO: 46482 - RNA, 21 nt, Homo sapiens
gugggccccagugagagacug

SEQ ID NO: 46483 - RNA, 21 nt, Homo sapiens
aagucaggaccaggggucgcc

SEQ ID NO: 46484 - RNA, 18 nt, Homo sapiens
ugacuuugaacuaugaag

SEQ ID NO: 46485 - RNA, 21 nt, Homo sapiens
ugggugggcuuagggacgcug

SEQ ID NO: 46486 - RNA, 24 nt, Homo sapiens
auccucagcgccugccaggagcca

SEQ ID NO: 46487 - RNA, 17 nt, Homo sapiens
cacugcuaauucgggcc

SEQ ID NO: 46488 - RNA, 22 nt, Homo sapiens
ucugccucucccacauuccucc

SEQ ID NO: 46489 - RNA, 20 nt, Homo sapiens
ugccucucccacauuccucc

SEQ ID NO: 46490 - RNA, 19 nt, Homo sapiens
aacugccagacucaaaaua

SEQ ID NO: 46491 - RNA, 16 nt, Homo sapiens
aauuuuuggugcuugg

SEQ ID NO: 46492 - RNA, 20 nt, Homo sapiens
ccaagcaaagaauuguaacu

SEQ ID NO: 46493 - RNA, 20 nt, Homo sapiens
ccuuuccuuugucuugaucu

SEQ ID NO: 46494 - RNA, 20 nt, Homo sapiens
cuaaauauugaaaucaauua

SEQ ID NO: 46495 - RNA, 22 nt, Homo sapiens
cuauuugagacuaaaguaguau

SEQ ID NO: 46496 - RNA, 20 nt, Homo sapiens
guaguuuccuuaguuuuugu

SEQ ID NO: 46497 - RNA, 18 nt, Homo sapiens
uacaguauuuguguuggc

SEQ ID NO: 46498 - RNA, 17 nt, Homo sapiens
ucaagugauucuccugc

SEQ ID NO: 46499 - RNA, 25 nt, Homo sapiens
ucuuugugguaguuuccuuaguuuu

SEQ ID NO: 46500 - RNA, 22 nt, Homo sapiens
ucuuuuuaauaagaaacuuugc

SEQ ID NO: 46501 - RNA, 20 nt, Homo sapiens
gaugugagagugucauucca

SEQ ID NO: 46502 - RNA, 19 nt, Homo sapiens
cccuggccucucagcagga

SEQ ID NO: 46503 - RNA, 20 nt, Homo sapiens
cuagcccaguucccaucuag

SEQ ID NO: 46504 - RNA, 19 nt, Homo sapiens
cugucuagcccaguuccca

SEQ ID NO: 46505 - RNA, 22 nt, Homo sapiens
ucuuguaauaggugauaauguu

SEQ ID NO: 46506 - RNA, 24 nt, Homo sapiens
aggauaauuugcauauccaucacc

SEQ ID NO: 46507 - RNA, 18 nt, Homo sapiens
aguauugcauaacuuuaa

SEQ ID NO: 46508 - RNA, 19 nt, Homo sapiens
auccuggugguaggucucu

SEQ ID NO: 46509 - RNA, 20 nt, Homo sapiens
caaaggauauaaaugacuaa

SEQ ID NO: 46510 - RNA, 18 nt, Homo sapiens
ccugagccugcauggccu

SEQ ID NO: 46511 - RNA, 22 nt, Homo sapiens
gacaagccugagcaacauauca

SEQ ID NO: 46512 - RNA, 19 nt, Homo sapiens
gacgcaggcgccauugcac

SEQ ID NO: 46513 - RNA, 18 nt, Homo sapiens
gagcagcuacguaaccug

SEQ ID NO: 46514 - RNA, 18 nt, Homo sapiens
gccauaucacugagggua

SEQ ID NO: 46515 - RNA, 17 nt, Homo sapiens
ggaucaggcagcuccaa

SEQ ID NO: 46516 - RNA, 18 nt, Homo sapiens
uuacaccuucuuucugua

SEQ ID NO: 46517 - RNA, 20 nt, Homo sapiens
uuauacauauuuguagggua

SEQ ID NO: 46518 - RNA, 18 nt, Homo sapiens
ccagcuucugggcccacu

SEQ ID NO: 46519 - RNA, 23 nt, Homo sapiens
ggacccucccugcccacccccuc

SEQ ID NO: 46520 - RNA, 17 nt, Homo sapiens
augugaacggguuauuc

SEQ ID NO: 46521 - RNA, 19 nt, Homo sapiens
caaauauucaacaacucca

SEQ ID NO: 46522 - RNA, 18 nt, Homo sapiens
ccaugggauauggagcca

SEQ ID NO: 46523 - RNA, 15 nt, Homo sapiens
gucaaggaucuauag

SEQ ID NO: 46524 - RNA, 18 nt, Homo sapiens
gucauaucaaaaauauca

SEQ ID NO: 46525 - RNA, 23 nt, Homo sapiens
ccaggcacuaggcaaccaggggu

SEQ ID NO: 46526 - RNA, 19 nt, Homo sapiens
guucuacuucucaggcugg

SEQ ID NO: 46527 - RNA, 20 nt, Homo sapiens
uuuuaugaugcuuugaccuu

SEQ ID NO: 46528 - RNA, 23 nt, Homo sapiens
accaccgggucacacugcugccu

SEQ ID NO: 46529 - RNA, 16 nt, Homo sapiens
gugugagccagacuga

SEQ ID NO: 46530 - RNA, 18 nt, Homo sapiens
ugaaccuuccugugccac

SEQ ID NO: 46531 - RNA, 20 nt, Homo sapiens
ugggguuguggugggcaucc

SEQ ID NO: 46532 - RNA, 18 nt, Homo sapiens
uuccagugccugauccag

SEQ ID NO: 46533 - RNA, 19 nt, Homo sapiens
aaaaucaccaggcucacuc

SEQ ID NO: 46534 - RNA, 23 nt, Homo sapiens
gcuugcggcccgcuggcuccuca

SEQ ID NO: 46535 - RNA, 21 nt, Homo sapiens
ccuccccgcaccgaguucuca

SEQ ID NO: 46536 - RNA, 18 nt, Homo sapiens
cucuccuuccaaccuggu

SEQ ID NO: 46537 - RNA, 18 nt, Homo sapiens
gccugcuccacccaggga

SEQ ID NO: 46538 - RNA, 20 nt, Homo sapiens
gucauaauagacuucccucu

SEQ ID NO: 46539 - RNA, 19 nt, Homo sapiens
uccuguggaggcugccagc

SEQ ID NO: 46540 - RNA, 23 nt, Homo sapiens
cggaucucuccaacagcugcucc

SEQ ID NO: 46541 - RNA, 20 nt, Homo sapiens
gccugcuccagcugcaggga

SEQ ID NO: 46542 - RNA, 23 nt, Homo sapiens
cggaucucuccaacagcugcucc

SEQ ID NO: 46543 - RNA, 20 nt, Homo sapiens
gccugcuccagcugcaggga

SEQ ID NO: 46544 - RNA, 22 nt, Homo sapiens
ucuggcugccaaagccaugaga

SEQ ID NO: 46545 - RNA, 20 nt, Homo sapiens
uuccagaaucugaucgccag

SEQ ID NO: 46546 - RNA, 24 nt, Homo sapiens
cuucacgccauauucuuaccaguc

SEQ ID NO: 46547 - RNA, 19 nt, Homo sapiens
ccagccccaccgcccaccu

SEQ ID NO: 46548 - RNA, 22 nt, Homo sapiens
gccaaagccaaacagaacuuca

SEQ ID NO: 46549 - RNA, 20 nt, Homo sapiens
cugucuccaucuccaccucc

SEQ ID NO: 46550 - RNA, 20 nt, Homo sapiens
accccuaacuuucucaccuc

SEQ ID NO: 46551 - RNA, 22 nt, Homo sapiens
acacagagggacaaacucaaac

SEQ ID NO: 46552 - RNA, 20 nt, Homo sapiens
ucaucagagccuggaauuca

SEQ ID NO: 46553 - RNA, 23 nt, Homo sapiens
uagccagaagcaaagccacugua

SEQ ID NO: 46554 - RNA, 22 nt, Homo sapiens
uccaugcaacuucccuguuccu

SEQ ID NO: 46555 - RNA, 19 nt, Homo sapiens
caccaagagcccucuguca

SEQ ID NO: 46556 - RNA, 24 nt, Homo sapiens
ccucugucauagccuaugcugccu

SEQ ID NO: 46557 - RNA, 18 nt, Homo sapiens
uggagcuugggauccuga

SEQ ID NO: 46558 - RNA, 20 nt, Homo sapiens
acagcucaugacucaccucc

SEQ ID NO: 46559 - RNA, 21 nt, Homo sapiens
cuaaaggaagcccucuggagc

SEQ ID NO: 46560 - RNA, 16 nt, Homo sapiens
gaggacucauaauuga

SEQ ID NO: 46561 - RNA, 22 nt, Homo sapiens
ccagggugcgcucaguugcugc

SEQ ID NO: 46562 - RNA, 21 nt, Homo sapiens
cacucucccuaucccauuaga

SEQ ID NO: 46563 - RNA, 20 nt, Homo sapiens
aaggaacuguccgcagugug

SEQ ID NO: 46564 - RNA, 18 nt, Homo sapiens
ccagcaucccuguuccag

SEQ ID NO: 46565 - RNA, 17 nt, Homo sapiens
accacgggcugcuggcc

SEQ ID NO: 46566 - RNA, 20 nt, Homo sapiens
gcuggcuccugggcgcccca

SEQ ID NO: 46567 - RNA, 21 nt, Homo sapiens
caugcugggacaugccccccg

SEQ ID NO: 46568 - RNA, 19 nt, Homo sapiens
uccacuucacagaugagga

SEQ ID NO: 46569 - RNA, 20 nt, Homo sapiens
accgcccccgacgcccaugc

SEQ ID NO: 46570 - RNA, 19 nt, Homo sapiens
ccuggguaacugcugguuc

SEQ ID NO: 46571 - RNA, 22 nt, Homo sapiens
agggcaucccccagacucaacu

SEQ ID NO: 46572 - RNA, 20 nt, Homo sapiens
cccacgagccccaagccccu

SEQ ID NO: 46573 - RNA, 21 nt, Homo sapiens
cccagaaagcagaacccagga

SEQ ID NO: 46574 - RNA, 21 nt, Homo sapiens
ccuugaugagacugacugugg

SEQ ID NO: 46575 - RNA, 23 nt, Homo sapiens
gcuugggcacagugcccuggcuc

SEQ ID NO: 46576 - RNA, 20 nt, Homo sapiens
gggcacccccacuugccucc

SEQ ID NO: 46577 - RNA, 19 nt, Homo sapiens
ucgauuuguccccuagcuu

SEQ ID NO: 46578 - RNA, 18 nt, Homo sapiens
uuccagaaacacugcccc

SEQ ID NO: 46579 - RNA, 19 nt, Homo sapiens
ggggcggccucgccgcgca

SEQ ID NO: 46580 - RNA, 16 nt, Homo sapiens
cgcccaacggcuuuuc

SEQ ID NO: 46581 - RNA, 21 nt, Homo sapiens
cucaaccaccauggccccuga

SEQ ID NO: 46582 - RNA, 18 nt, Homo sapiens
ggacccucaggccuguca

SEQ ID NO: 46583 - RNA, 17 nt, Homo sapiens
aguggcuguggcacuga

SEQ ID NO: 46584 - RNA, 16 nt, Homo sapiens
aggcaggauugaaaca

SEQ ID NO: 46585 - RNA, 21 nt, Homo sapiens
gcuggcagaauccugguguca

SEQ ID NO: 46586 - RNA, 23 nt, Homo sapiens
ccugcauuugcucuucuaacaaa

SEQ ID NO: 46587 - RNA, 21 nt, Homo sapiens
gcccuuccucggcaucuggag

SEQ ID NO: 46588 - RNA, 23 nt, Homo sapiens
cuugaaagcggauucagaggaca

SEQ ID NO: 46589 - RNA, 17 nt, Homo sapiens
ggggcagcuccucacca

SEQ ID NO: 46590 - RNA, 17 nt, Homo sapiens
ugaaagcggauucagag

SEQ ID NO: 46591 - RNA, 21 nt, Homo sapiens
accucuaaguggcucugggga

SEQ ID NO: 46592 - RNA, 20 nt, Homo sapiens
uccugaugauggaauaaucc

SEQ ID NO: 46593 - RNA, 16 nt, Homo sapiens
cuggcgugucggcaga

SEQ ID NO: 46594 - RNA, 18 nt, Homo sapiens
ggcucugcacacucaggu

SEQ ID NO: 46595 - RNA, 19 nt, Homo sapiens
ccauaauuucaggcuaaag

SEQ ID NO: 46596 - RNA, 20 nt, Homo sapiens
accaaagacccuacugggca

SEQ ID NO: 46597 - RNA, 20 nt, Homo sapiens
cgagggcggccagcguguga

SEQ ID NO: 46598 - RNA, 25 nt, Homo sapiens
gggaaugggcuauggcagcccuggc

SEQ ID NO: 46599 - RNA, 19 nt, Homo sapiens
aaguagccuucauaucuca

SEQ ID NO: 46600 - RNA, 19 nt, Homo sapiens
gcgccugagcccccggggg

SEQ ID NO: 46601 - RNA, 23 nt, Homo sapiens
aggaaaaagagaaaugcuucacu

SEQ ID NO: 46602 - RNA, 23 nt, Homo sapiens
cccugcaacagaaggccuuugaa

SEQ ID NO: 46603 - RNA, 18 nt, Homo sapiens
acacguucagugcccuca

SEQ ID NO: 46604 - RNA, 21 nt, Homo sapiens
cagacagaaaaagaagaagcu

SEQ ID NO: 46605 - RNA, 18 nt, Homo sapiens
uucccuuggaaugguguu

SEQ ID NO: 46606 - RNA, 20 nt, Homo sapiens
cagcugguguccaccaucau

SEQ ID NO: 46607 - RNA, 22 nt, Homo sapiens
caggugauccacuccauccuca

SEQ ID NO: 46608 - RNA, 23 nt, Homo sapiens
gcaacguggugguccagcuuuau

SEQ ID NO: 46609 - RNA, 18 nt, Homo sapiens
caguccgcauaugccaga

SEQ ID NO: 46610 - RNA, 21 nt, Homo sapiens
caggaucuuccaggcuuggca

SEQ ID NO: 46611 - RNA, 24 nt, Homo sapiens
cucugacacugcugcaacaugcaa

SEQ ID NO: 46612 - RNA, 19 nt, Homo sapiens
gcgagcagaacugauuaca

SEQ ID NO: 46613 - RNA, 21 nt, Homo sapiens
cucuugcuuaucaacauuuuu

SEQ ID NO: 46614 - RNA, 22 nt, Homo sapiens
aaccaggccggccacucagaga

SEQ ID NO: 46615 - RNA, 24 nt, Homo sapiens
aaccaggcuggcaccgcccagagg

SEQ ID NO: 46616 - RNA, 19 nt, Homo sapiens
accuguccagugcuggcca

SEQ ID NO: 46617 - RNA, 19 nt, Homo sapiens
agacucggggcgguaccug

SEQ ID NO: 46618 - RNA, 20 nt, Homo sapiens
aucuccaaagacgaccccuu

SEQ ID NO: 46619 - RNA, 21 nt, Homo sapiens
cauccagcugcucccaggcug

SEQ ID NO: 46620 - RNA, 18 nt, Homo sapiens
ccaaacacuuccagcuca

SEQ ID NO: 46621 - RNA, 20 nt, Homo sapiens
cccaagaucacguggcaccg

SEQ ID NO: 46622 - RNA, 22 nt, Homo sapiens
cccuggugagcaggccugggga

SEQ ID NO: 46623 - RNA, 23 nt, Homo sapiens
cccuggugcuaaaaggccugagg

SEQ ID NO: 46624 - RNA, 20 nt, Homo sapiens
ccguggcagagagcaacgag

SEQ ID NO: 46625 - RNA, 21 nt, Homo sapiens
cuggagugccagagccacgcc

SEQ ID NO: 46626 - RNA, 19 nt, Homo sapiens
gagaucguguggcugaagg

SEQ ID NO: 46627 - RNA, 17 nt, Homo sapiens
gaugggcagccgccgcc

SEQ ID NO: 46628 - RNA, 20 nt, Homo sapiens
gcacugaaccaggccggcca

SEQ ID NO: 46629 - RNA, 21 nt, Homo sapiens
gcaucuacacuugugcugcua

SEQ ID NO: 46630 - RNA, 19 nt, Homo sapiens
ggcucuggccacacccuca

SEQ ID NO: 46631 - RNA, 20 nt, Homo sapiens
ucaggccucuucgccugcca

SEQ ID NO: 46632 - RNA, 23 nt, Homo sapiens
uccugguggcugaaggcuuggga

SEQ ID NO: 46633 - RNA, 19 nt, Homo sapiens
ugcccagggcaccccccag

SEQ ID NO: 46634 - RNA, 23 nt, Homo sapiens
ugcccuccaacgcccugcuccuc

SEQ ID NO: 46635 - RNA, 19 nt, Homo sapiens
uggcccccacacagguacc

SEQ ID NO: 46636 - RNA, 18 nt, Homo sapiens
uuguggucggccuggccc

SEQ ID NO: 46637 - RNA, 19 nt, Homo sapiens
uuuggcguggccacacuca

SEQ ID NO: 46638 - RNA, 20 nt, Homo sapiens
ccucuuugucaaccgcaugu

SEQ ID NO: 46639 - RNA, 20 nt, Homo sapiens
ggauggaaccaaucuuugag

SEQ ID NO: 46640 - RNA, 16 nt, Homo sapiens
ugggcaggccacuuuu

SEQ ID NO: 46641 - RNA, 19 nt, Homo sapiens
ggccacuuuguagaaauca

SEQ ID NO: 46642 - RNA, 23 nt, Homo sapiens
ucaccaggcaaauaccuguucug

SEQ ID NO: 46643 - RNA, 24 nt, Homo sapiens
uuugggggcccauuacacacccca

SEQ ID NO: 46644 - RNA, 18 nt, Homo sapiens
augcugauuuggugacca

SEQ ID NO: 46645 - RNA, 22 nt, Homo sapiens
uccaaccuucccaaacgccucc

SEQ ID NO: 46646 - RNA, 23 nt, Homo sapiens
ugggggacccaauguaggagcug

SEQ ID NO: 46647 - RNA, 24 nt, Homo sapiens
cccuuccccaccccagguguccug

SEQ ID NO: 46648 - RNA, 24 nt, Homo sapiens
aauaaguaucuuugggaaaucuuu

SEQ ID NO: 46649 - RNA, 18 nt, Homo sapiens
aauaguggaaaugaugaa

SEQ ID NO: 46650 - RNA, 18 nt, Homo sapiens
accguacguugccaaaua

SEQ ID NO: 46651 - RNA, 18 nt, Homo sapiens
aguaaccacaaauugcca

SEQ ID NO: 46652 - RNA, 20 nt, Homo sapiens
augugaauacagauaucaca

SEQ ID NO: 46653 - RNA, 17 nt, Homo sapiens
guuuuuauucucacuua

SEQ ID NO: 46654 - RNA, 22 nt, Homo sapiens
ugaaagaagagacaggcaauga

SEQ ID NO: 46655 - RNA, 17 nt, Homo sapiens
agaagaaaagagcaccu

SEQ ID NO: 46656 - RNA, 16 nt, Homo sapiens
ccacuauuacaagcca

SEQ ID NO: 46657 - RNA, 18 nt, Homo sapiens
ccagugugauggcuguga

SEQ ID NO: 46658 - RNA, 18 nt, Homo sapiens
ccuaucaguugcaaaagc

SEQ ID NO: 46659 - RNA, 17 nt, Homo sapiens
ggacacaccugcccaug

SEQ ID NO: 46660 - RNA, 19 nt, Homo sapiens
ggccccaaaacuucccuac

SEQ ID NO: 46661 - RNA, 22 nt, Homo sapiens
uaagguaacugggauuugguua

SEQ ID NO: 46662 - RNA, 21 nt, Homo sapiens
uaccagugugauggcugugac

SEQ ID NO: 46663 - RNA, 20 nt, Homo sapiens
agugacccuucuccaccccc

SEQ ID NO: 46664 - RNA, 23 nt, Homo sapiens
cccuucuccacccccauauccua

SEQ ID NO: 46665 - RNA, 18 nt, Homo sapiens
uccagggccacguuccag

SEQ ID NO: 46666 - RNA, 23 nt, Homo sapiens
ugcaggaggccccugugcaggug

SEQ ID NO: 46667 - RNA, 23 nt, Homo sapiens
ccacauuucucucuucucccuca

SEQ ID NO: 46668 - RNA, 22 nt, Homo sapiens
ccuccuuuccccucuucccugg

SEQ ID NO: 46669 - RNA, 25 nt, Homo sapiens
gccucuuucccuccuccucucccuc

SEQ ID NO: 46670 - RNA, 19 nt, Homo sapiens
cuccccauccccaucuggu

SEQ ID NO: 46671 - RNA, 22 nt, Homo sapiens
cgcgcgccuccuuccucgccgc

SEQ ID NO: 46672 - RNA, 17 nt, Homo sapiens
agaacauagagauaggg

SEQ ID NO: 46673 - RNA, 22 nt, Homo sapiens
agaacaugaagaaaugacccca

SEQ ID NO: 46674 - RNA, 17 nt, Homo sapiens
augagaacaccacacca

SEQ ID NO: 46675 - RNA, 17 nt, Homo sapiens
augagaacaccacacca

SEQ ID NO: 46676 - RNA, 17 nt, Homo sapiens
augagaacaccacacca

SEQ ID NO: 46677 - RNA, 17 nt, Homo sapiens
augagaacaccacacca

SEQ ID NO: 46678 - RNA, 17 nt, Homo sapiens
augagaacaccacacca

SEQ ID NO: 46679 - RNA, 17 nt, Homo sapiens
augagaacaccacauca

SEQ ID NO: 46680 - RNA, 19 nt, Homo sapiens
caccacaccauccccagca

SEQ ID NO: 46681 - RNA, 20 nt, Homo sapiens
ccaugagggggaggcugcca

SEQ ID NO: 46682 - RNA, 20 nt, Homo sapiens
gaagaaaacuccagcaacca

SEQ ID NO: 46683 - RNA, 19 nt, Homo sapiens
guaucaagaaggccugcca

SEQ ID NO: 46684 - RNA, 21 nt, Homo sapiens
ucugguugaaccacguggcca

SEQ ID NO: 46685 - RNA, 21 nt, Homo sapiens
uguguuggcuuaauuucugga

SEQ ID NO: 46686 - RNA, 19 nt, Homo sapiens
ccagguuccuucuugcaca

SEQ ID NO: 46687 - RNA, 19 nt, Homo sapiens
cugcugguuucccgaggga

SEQ ID NO: 46688 - RNA, 17 nt, Homo sapiens
ggcccccugaaaucuca

SEQ ID NO: 46689 - RNA, 26 nt, Homo sapiens
ucuguccaggugccccucaucaucac

SEQ ID NO: 46690 - RNA, 22 nt, Homo sapiens
agacacuggaaagagaauacua

SEQ ID NO: 46691 - RNA, 15 nt, Homo sapiens
aggagaccccuccca

SEQ ID NO: 46692 - RNA, 21 nt, Homo sapiens
aguugcacauguuuuccccua

SEQ ID NO: 46693 - RNA, 20 nt, Homo sapiens
ggccucacucuguugcacaa

SEQ ID NO: 46694 - RNA, 17 nt, Homo sapiens
ucaaaaucuccacagua

SEQ ID NO: 46695 - RNA, 18 nt, Homo sapiens
augcugauuuggugacca

SEQ ID NO: 46696 - RNA, 22 nt, Homo sapiens
uccaaccuucccaaacgccucc

SEQ ID NO: 46697 - RNA, 23 nt, Homo sapiens
ugggggacccaauguaggagcug

SEQ ID NO: 46698 - RNA, 21 nt, Homo sapiens
cagggugcgcuggucccgguc

SEQ ID NO: 46699 - RNA, 16 nt, Homo sapiens
ugggcaggccacuuuu

SEQ ID NO: 46700 - RNA, 19 nt, Homo sapiens
cuccccauccccaucuggu

SEQ ID NO: 46701 - RNA, 20 nt, Homo sapiens
agugacccuucuccaccccc

SEQ ID NO: 46702 - RNA, 23 nt, Homo sapiens
cccuucuccacccccauauccua

SEQ ID NO: 46703 - RNA, 18 nt, Homo sapiens
uccagggccacguuccag

SEQ ID NO: 46704 - RNA, 23 nt, Homo sapiens
ugcaggaggccccugugcaggug

SEQ ID NO: 46705 - RNA, 16 nt, Homo sapiens
ccacuauuacaagcca

SEQ ID NO: 46706 - RNA, 18 nt, Homo sapiens
ccagugugauggcuguga

SEQ ID NO: 46707 - RNA, 18 nt, Homo sapiens
ccuaucaguugcaaaagc

SEQ ID NO: 46708 - RNA, 17 nt, Homo sapiens
ggacacaccugcccaug

SEQ ID NO: 46709 - RNA, 19 nt, Homo sapiens
ggccccaaaacuucccuac

SEQ ID NO: 46710 - RNA, 22 nt, Homo sapiens
uaagguaacugggauuugguua

SEQ ID NO: 46711 - RNA, 21 nt, Homo sapiens
uaccagugugauggcugugac

SEQ ID NO: 46712 - RNA, 23 nt, Homo sapiens
ccacauuucucucuucucccuca

SEQ ID NO: 46713 - RNA, 22 nt, Homo sapiens
ccuccuuuccccucuucccugg

SEQ ID NO: 46714 - RNA, 25 nt, Homo sapiens
gccucuuucccuccuccucucccuc

SEQ ID NO: 46715 - RNA, 17 nt, Homo sapiens
agaagaaaagagcaccu

SEQ ID NO: 46716 - RNA, 22 nt, Homo sapiens
cgcgcgccuccuuccucgccgc

SEQ ID NO: 46717 - RNA, 24 nt, Homo sapiens
aauaaguaucuuugggaaaucuuu

SEQ ID NO: 46718 - RNA, 18 nt, Homo sapiens
aauaguggaaaugaugaa

SEQ ID NO: 46719 - RNA, 18 nt, Homo sapiens
accguacguugccaaaua

SEQ ID NO: 46720 - RNA, 18 nt, Homo sapiens
aguaaccacaaauugcca

SEQ ID NO: 46721 - RNA, 20 nt, Homo sapiens
augugaauacagauaucaca

SEQ ID NO: 46722 - RNA, 17 nt, Homo sapiens
guuuuuauucucacuua

SEQ ID NO: 46723 - RNA, 22 nt, Homo sapiens
ugaaagaagagacaggcaauga

SEQ ID NO: 46724 - RNA, 18 nt, Homo sapiens
cauaucccuuuucuccuc

SEQ ID NO: 46725 - RNA, 19 nt, Homo sapiens
cuaauuccucaguaaccuc

SEQ ID NO: 46726 - RNA, 20 nt, Homo sapiens
gaagcaacaaauucccuuua

SEQ ID NO: 46727 - RNA, 23 nt, Homo sapiens
uccaguaacacagaagcaaccaa

SEQ ID NO: 46728 - RNA, 17 nt, Homo sapiens
agaacauagagauaggg

SEQ ID NO: 46729 - RNA, 22 nt, Homo sapiens
agaacaugaagaaaugacccca

SEQ ID NO: 46730 - RNA, 17 nt, Homo sapiens
augagaacaccacacca

SEQ ID NO: 46731 - RNA, 17 nt, Homo sapiens
augagaacaccacacca

SEQ ID NO: 46732 - RNA, 17 nt, Homo sapiens
augagaacaccacacca

SEQ ID NO: 46733 - RNA, 17 nt, Homo sapiens
augagaacaccacacca

SEQ ID NO: 46734 - RNA, 17 nt, Homo sapiens
augagaacaccacacca

SEQ ID NO: 46735 - RNA, 17 nt, Homo sapiens
augagaacaccacauca

SEQ ID NO: 46736 - RNA, 19 nt, Homo sapiens
caccacaccauccccagca

SEQ ID NO: 46737 - RNA, 20 nt, Homo sapiens
ccaugagggggaggcugcca

SEQ ID NO: 46738 - RNA, 20 nt, Homo sapiens
gaagaaaacuccagcaacca

SEQ ID NO: 46739 - RNA, 19 nt, Homo sapiens
guaucaagaaggccugcca

SEQ ID NO: 46740 - RNA, 22 nt, Homo sapiens
ccggaacccccuuccuguuccu

SEQ ID NO: 46741 - RNA, 18 nt, Homo sapiens
gauccuuccuggacucca

SEQ ID NO: 46742 - RNA, 18 nt, Homo sapiens
gauggcacagggcugugg

SEQ ID NO: 46743 - RNA, 23 nt, Homo sapiens
ugagguuccugggcccgcaccac

SEQ ID NO: 46744 - RNA, 21 nt, Homo sapiens
ugguguuuggcgcuggaauua

SEQ ID NO: 46745 - RNA, 21 nt, Homo sapiens
ucugguugaaccacguggcca

SEQ ID NO: 46746 - RNA, 21 nt, Homo sapiens
uguguuggcuuaauuucugga

SEQ ID NO: 46747 - RNA, 22 nt, Homo sapiens
agacacuggaaagagaauacua

SEQ ID NO: 46748 - RNA, 15 nt, Homo sapiens
aggagaccccuccca

SEQ ID NO: 46749 - RNA, 21 nt, Homo sapiens
aguugcacauguuuuccccua

SEQ ID NO: 46750 - RNA, 20 nt, Homo sapiens
ggccucacucuguugcacaa

SEQ ID NO: 46751 - RNA, 17 nt, Homo sapiens
ucaaaaucuccacagua

SEQ ID NO: 46752 - RNA, 19 nt, Homo sapiens
aaaccuuaaaauuugguga

SEQ ID NO: 46753 - RNA, 22 nt, Homo sapiens
cuuggcuccagcuggucccucc

SEQ ID NO: 46754 - RNA, 21 nt, Homo sapiens
gugauaaauauccaugaaauc

SEQ ID NO: 46755 - RNA, 21 nt, Homo sapiens
uggguggaucaccugagguua

SEQ ID NO: 46756 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 46757 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 46758 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 46759 - DNA, 761 bp, Homo sapiens
atgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccggg

SEQ ID NO: 46760 - DNA, 42 bp, Homo Sapiens
taatacgactcactatagggtgaggtagtaagttgtattgtt

SEQ ID NO: 46761 - DNA, 41 bp, Homo Sapiens
aattaaccctcactaaagggaaagtagtaagttgtatagtt

SEQ ID NO: 46762 - DNA, 40 bp, Homo Sapiens
taatacgactcactataggcccttattagaggattctgct

SEQ ID NO: 46763 - DNA, 41 bp, Homo Sapiens
aattaaccctcactaaaggtttttttttcctgagacagagt

SEQ ID NO: 46764 - DNA, 20 bp, Homo Sapiens
gaggcaggagaattgcttga

SEQ ID NO: 46765 - DNA, 39 bp, Homo Sapiens
aattaaccctcactaaaggcctgagacagagtcttgctc
